US009157092B2

(12) United States Patent
Sanz Molinero

(10) Patent No.: US 9,157,092 B2
(45) Date of Patent: Oct. 13, 2015

(54) PLANTS HAVING ENHANCED YIELD-RELATED TRAITS AND A METHOD FOR MAKING THE SAME

(75) Inventor: Ana Isabel Sanz Molinero, Madrid (ES)

(73) Assignees: BASF Plant Science Company GmbH, Ludwigshafen (DE); Crop Functional Genomics Center, Seoul (KR)

( * ) Notice: Subject to any disclaimer, the term of this patent is extended or adjusted under 35 U.S.C. 154(b) by 456 days.

(21) Appl. No.: 13/502,643

(22) PCT Filed: Oct. 14, 2010

(86) PCT No.: PCT/EP2010/065462
§ 371 (c)(1),
(2), (4) Date: Jun. 22, 2012

(87) PCT Pub. No.: WO2011/048009
PCT Pub. Date: Apr. 28, 2011

(65) Prior Publication Data
US 2012/0266327 A1   Oct. 18, 2012

Related U.S. Application Data

(60) Provisional application No. 61/253,855, filed on Oct. 22, 2009, provisional application No. 61/253,856, filed on Oct. 22, 2009, provisional application No. 61/254,238, filed on Oct. 23, 2009, provisional application No. 61/254,222, filed on Oct. 23, 2009.

(30) Foreign Application Priority Data

Oct. 22, 2009   (EP) .................................... 09173796
Oct. 22, 2009   (EP) .................................... 09173802
Oct. 23, 2009   (EP) .................................... 09173919
Oct. 23, 2009   (EP) .................................... 09173961

(51) Int. Cl.
*C12N 15/82*      (2006.01)
*A01H 5/10*       (2006.01)

(52) U.S. Cl.
CPC ................................ *C12N 15/8261* (2013.01)

(58) Field of Classification Search
None
See application file for complete search history.

(56) References Cited

U.S. PATENT DOCUMENTS

| 8,362,325 B2 * | 1/2013 | Troukhan et al. ............. 800/295 |
| 2006/0123505 A1 * | 6/2006 | Kikuchi et al. ............... 800/278 |
| 2009/0183270 A1 | 7/2009 | Adams et al. |
| 2013/0145497 A1 * | 6/2013 | Choi et al. ................... 800/290 |

FOREIGN PATENT DOCUMENTS

| FR | 2 829 904 A1 | 3/2003 |
| WO | WO-01/33945 A1 | 5/2001 |
| WO | WO-2009/095455 A1 | 8/2009 |

OTHER PUBLICATIONS

Lim et al, 2007, Biochem. & Biophys. Res. Commun., 362:431-436.*
Zifarelli et al, 2010, FEBS Letters, 584:2122-2127.*
Sylvia de Pater et al, 1992, Plant J., 2:837-844.*
International Search Report for PCT/EP2010/065462 mailed Feb. 17, 2011.
Geelen, D., et al., "Disruption of Putative Anion Channel Gene AtCLC-a in *Arabidopsis* Suggests a Role in the Regulation of Nitrate Content," Plant J., 2000, vol. 21, No. 3, pp. 259-267.
Barbier-Brygoo, H., et al., "Anion Channels in Higher Plants: Functional Characterization, Molecular Structure and Physiological Role," Biochimica et Biophysica Acta, 2000, vol. 1465, pp. 199-218.
De Angeli, A., et al., "The Nitrate/Proton Antiporter AtCLCa Mediates Nitrate Accumulation in Plant Vacuoles," Nature, 2006, vol. 442, No. 7105, pp. 939-942.
International Preliminary Report on Patentability for PCT/EP2010/065462 mailed May 3, 2011.
Aharoni, A., et al., "The SHINE Clade of AP2 Domain Transcription Factors Activates Wax Biosynthesis, Alters Cuticle Properties, and Confers Drought Tolerance when Overexpressed in *Arabidopsis*", The Plant Cell, 2004, vol. 16, pp. 2463-2480.
Alonso, J. M., et al., "Genome-Wide Insertional Mutagenesis of *Arabidopsis thaliana*", Science, 2003, vol. 301, pp. 653-657.
Banno, H., et al., "Overexpression of *Arabidopsis* ESR1 Induces Initiation of Shoot Regeneration", The Plant Cell, 2001, vol. 13, pp. 2609-2618.
Boutilier, K., et al., "Ectopic Expression of Baby Boom Triggers a Conversion from Vegetative to Embryonic Growth", The Plant Cell, 2002, vol. 14, pp. 1737-1749.

(Continued)

*Primary Examiner* — David H Kruse
*Assistant Examiner* — Jason Deveau Rosen
(74) *Attorney, Agent, or Firm* — Drinker Biddle & Reath LLP

(57) ABSTRACT

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding a CLC-like (Chloride Channel-like) polypeptide, or an OsBURP-like (BURP-domain containing protein) polypeptide, or an AP2/ERF polypeptide or a protein fusion comprising a TPS (trehalose-6-phosphate synthase) and a TPP (trehalose-6-phosphate phosphatase) polypeptide or modulating one or more nucleic acid encoding a TPS and a TPP enzyme, whether comprised in the same or in separate molecules. The present invention also concerns plants having modulated expression of a nucleic acids and constructs comprising them, useful in performing the methods of the invention.

18 Claims, 36 Drawing Sheets

(56) References Cited

OTHER PUBLICATIONS

Chuck, G., et al., "The Control of Maize Spikelet Meristem Fate by the APETALA2-Like Gene indeterminate?spikelet1", Genes & Development, 1998, vol. 12, pp. 1145-1154.
Chuck, G., et al,, "The Control of Spikelet Meristem Identity by the branched silkless1 Gene in Maize", Science, 2002, vol. 298, pp. 1238-1241.
Ding, X., et al., "Genome-Wide Identification of Burp Domain-Containing Genes in Rice Reveals a Gene Family with Diverse Structures and Responses to Abiotic Stresses", Planta, 2009, vol. 230, pp. 149-163.
De Angeli, A., et al., "CLC-Mediated Anion Transport in Plant Cells", Phil. Trans. R. Soc. B, 2009, vol. 364, pp. 195-201.
Dubouzet, J. G., et al., "OsDREB Genes in Rice, *Oryza sativa* L., Encode Transcription Activators that Function in Drought-, High-Salt- and Cold-Responsive Gene Expression", The Plant Journal, 2003, vol. 33, pp. 751-763.
Eastmond, P. J., et al., "Trehalose-6-Phosphate Synthase 1, which Catalyses the First Step in Trehalose Synthesis, is Essential for *Arabidopsis* Embryo Maturation", The Plant Journal, 2002, vol. 29, No. 2, pp. 225-235.
Elliott, R. C., et al., "Aintegumenta, an APETALA2-Like Gene of *Arabidopsis* with Pleiotropic Roles in Ovule Development and Floral Organ Growth", The Plant Cell, 1996, vol. 8, pp. 155-168.
Hattori, J., et al., "A Conserved BURP Domain Defines a Novel Group of Plant Proteins with Unusual Primary Structures", Mol. Gen. Genet., 1998, vol. 259, pp. 424-428.
Hu, Y. X., et al., "*Arabidopsis* RAV1 is Down-Regulated by Brassinosteroid and May Act as a Negative Regulator During Plant Development", Cell Research, 2004, vol. 14, No. 1, pp. 8-15.
Kranz, H. D., et al., "Towards Functional Characterisation of the Members of the R2R3-MYB Gene Family from *Arabidopsis thaliana*", The Plant Journal, 1998, vol. 16, No. 2, pp. 263-276.
Moose, S. P., et al., "Glossy15, an APETALA2-Like Gene from Maize that Regulates Leaf Epidermal Cell Identity", Genes & Development, 1996, vol. 10, pp. 3018-3027.
Nakano, T., et al., "Genome-Wide Analysis of the ERF Gene Family in *Arabidopsis* and Rice", Plant Physiology, 2006, vol. 140, pp. 411-432.
Ohme-Takagi, M., et al., "Ethylene-Inducible DNA Binding Proteins that Interact with an Ethylene-Responsive Element", The Plant Cell, 1995, vol. 7, pp. 173-182.
Riechmann, J. L., et al., "*Arabidopsis* Transcription Factors: Genome-Wide Comparative Analysis Among Eukaryotes", Science, 2000, vol. 290, pp. 2105-2100.
Romero, C., et al., "Expression of the Yeast Trehalose-6-Phosphate Synthase Gene in Transgenic Tobacco Plants: Pleiotropic Phenotypes Include Drought Tolerance", Planta, 1997, vol. 201, pp. 293-297.
Sakuma, Y., et al., "DNA-Binding Specificity of the ERF/AP2 Domain of *Arabidopsis* DREBs, Transcription Factors Involved in Dehydration- and Cold-Inducible Gene Expression", Biochemical and Biophysical Research Communications, 2002, vol. 290, pp. 998-1009.
Satoh-Nagasawa, N., et al., "A Trehalose Metabolic Enzyme Controls Inflorescence Architecture in Maize", Nature, 2006, vol. 441, pp. 227-230.
Seo, H. S., et al., "Characterization of a Bifunctional Enzyme Fusion of Trehalose-6-Phosphate Synthetase and Trehalose-6-Phophate Phosphatase of *Escherichia coli*", Applied and Environmental Microbiology, 2000, vol. 66, No. 6, pp. 2484-2490.
Stockinger, E. J., et al., "*Arabidopsis thaliana* CBF1 Encodes an AP2 Domain-Containing Transcriptional Activator that Binds to the C-Repeat/DRE, a cis-acting DNA Regulatory Element that Stimulates Transcription in Response to Low Temperature and Water Deficit", Proc. Natl. Acad. Sci. USA, 1997, vol. 94, pp. 1035-1040.
Tian, C., et al., "Genome-Wide Analysis of the GRAS Gene Family in Rice and *Arabidopsis*", Plant Molecular Biology, 2004, vol. 54, pp. 519-532.
Toledo-Ortiz, G., et al., "The *Arabidopsis* Basic/Helix-Loop-Helix Transcription Factor Family", The Plant Cell, 2003, vol. 15, pp. 1749-1770.
Van Der Fits, L., et al,, "ORCA3, A Jasmonate-Responsive Transcriptional Regulator of Plant Primary and Secondary Metabolism", Science, 2000, vol. 289, pp. 295-297.
Van Der Graaff, E., et al., "Activation Tagging of the Leafy Petiole Gene Affects Leaf Petiole Development in *Arabidopsis thaliana*", Development, 2000, vol. 127, pp. 4971-4980.
Yamaguchi-Shinozaki, K., et al., "The Plant Hormone Abscisic Acid Mediates the Drought-Induced Expression but not the Seed-Specific Expression of rd22, a Gene Responsive to Dehydration Stress in *Arabidopsis thaliana*", Mol. Gen. Genet., 1993, vol. 238, pp. 17-25.
Yamamoto, S., et al,, "Elicitor-Responsive, Ethylene-Independent Activation of GCC Box-Mediated Transcription that is Regulated by Both Protein Phosphorylation and Dephosphorylation in Cultured Tobacco Cells", The Plant Journal, 1999, vol. 20, No. 5, pp. 571-579.
Zhang, J.-Y., et al,, "Overexpression of WXP1, a Putative *Medicago truncatula* AP2 Domain-Containing Transcription Factor Gene, Increases Cuticular Wax Accumulation and Enhances Drought Tolerance in Transgenic Alfalfa (*Medicago sativa*)", The Plant Journal, 2005, vol. 42, pp. 689-707.
Garg, A. K., et al., "Trehalose Accumulation in Rice Plants Confers High Tolerance Levels to Different Abiotic Stresses", PNAS, 2002, vol. 99, No. 25, pp. 15898-15903.

\* cited by examiner

MEEEQSPRLAAGEPERKLEDGVTDAEDPGCTGNAAMSSLEQPLLKRSNTLTASHLAMVG

AKVSHIESLDYEIIENDLFKHDWRRRSNVEVLQYIFLKWAMAFLVGLLTGVIASLINLA
     -----1-----

IENISGLKMLHMVQLVRKKRYWAGFLYFAGVNFGLTFIAAMLCVVFAPTAAGPGIPEIK
                                                        ----------2-

AYLNGVDTPNMFGAPQLIVKIIGSICAVSSGLDLGKEGPLVHIGACLANLLSQGGSGRH
-------                            ---------3--------

RLRLRWLRYFDNDRDRRDLITCGASSGVCAAFRAPVGGVLFALEEVATWWRSALLWRTF
                                    --------4---------

FSTATVVVVLRGFIEVCRNGRCGLFGEGGLILFDVGDVAVRYHAGDLLPVTIVGVLGGV
                   -------5-------

LGALYNHVLHKVLRVYNLINEKGRAAKLALALAVCALTSALLYVTPFAVPCTPCDPAFG

GACPTLGKSGNFKRFNCPEGHYNDLATLLHATNVDATRNIFSTGTAGEFRLDSLLIFFA
           --6--

VYCVLGLFTFGIAVPSGLFLPIILMGSAYGRVTALVLSRFARIDHGLYAVLGAAALMSG

SMRMTVSLVVIFLELTNNLLLLPITMFVLLIAKTVGDAFNPSIYEIILDLKGLPFLEAK
-7------                            -------8-------

PEPWMKDLTVGEL*AAAKPRAVALQVVERVSTVVEALRATRHNGFPVLDRPRPGVSELHG*

*LVLRSHLVAALRKRWFLPERRRTEEWEAREMFSSAELADKCGGVDELEISPEEMGMYVD*

*LHPLTNTTPYTVVETMSVAKAVVLFRSVALRHMLIMPKFQGPEISPIVGILTRQDLIAH*

*NI*LGAFPHLASKRKTH

FIGURE 1

```
CLUSTAL 2.0.11 multiple sequence alignment

AT5g40890        -MDEDGNLQISNS------NYNGEEEGEDPEN----NTLNQP-LLKRHRTLSSTPLALVG
AT3G27170        MVEEDLNQIGGNS------NYNG--EGGDPES----NTLNQP-LVKANRTLSSTPLALVG
Pt_829777        -MEADSSQLAEATAGH---NLEVGEEGRDPES----NTLHQP-LLKRNRTLSSNPLALVG
Gm19g25680_2     ------------------MENVEREEEIDPES----NPLNEP-LLKRNRTLSSNPLALVG
Gm19g25680_1     ------------------MENVEREEEIDPES----NPLNEP-LLKRNRTLSSNPLALVG
Gm16g06190       -MGEDSREFGKSTKINHKMEEVQREEEIDPES----NPLNEPLLLKRTRTLSSNPLALVG
Gm_TC286373      -MGEESSLLKESTSIN-DTNMVEEVEERDPES----NPLNEP-LLKRNRTLSSNPLALVG
Gm05g14760       -MGEESSLLKESTSIN-DTNMVEEVEERDPES----NPLNEP-LLKRNRTLSSNPLALVG
Os_TC285852      MEEEQSPRLAAGEPERKLEDGVTDAEDPGCTGNAAMSSLEQP-LLKRSNTLTASHLAMVG
Os03g48940_1     ------------------MARLAWTRLPTA-----DGAGAGAEGPGPVPASPSSAGYE
Os_TC299772      -------MLSGDQDLPDGIGMARLAWTRLPTA-----DGAGAGAEGPGPVPASPSSAGYE
Os03g48940_2     -------MLSGDQDLPDGIGMARLAWTRLPTA-----DGAGAGAEGPGPVPASPSSAGYE
Gm01g44950       -------MLSN--HFQNGIETARLVWSRIPNS-----EESQLLDDAVGILKKNDG-----
Gm11g00690       -------MLAN--HFQNGIETARLVWSRIPNS-----EESQLLDDAVGILKKNDG-----
AT5G26240        -------MLSN--HLQNGIESDNLLWSRVPES-----DDTSTDDITLLNSHRDGD-----
Pp_151168        ------------------------MLGYRDP-----------------------------
Pp_105025        --MGGNDEMGNVEEESLPPPHLDLYEPLLEKE-----KVATAGNANGNVINGTHHTAMIG

AT5g40890        AKVSHIESLDYEINENDLFKHDWRSRSKAQVFQYIFLKWTLACLVGLFTGLIATLINLAV
AT3G27170        AKVSHIESLDYEINENDLFKHDWRKRSKAQVLQYVFLKWTLACLVGLFTGLIATLINLAV
Pt_829777        AKVSHIESLDYEINENDLFKHDWRSRSKVQVLQYIFWKWTLAFLVGLLTGLIATFINLAV
Gm19g25680_2     EKVSYIESLDYEINENDLFKHDWRSRSRVQVLQYIFLKWLLAFLVGLLTGIIATLINLAV
Gm19g25680_1     EKVSYIESLDYEINENDLFKHDWRSRSRVQVLQYIFLKWLLAFLVGLLTGIIATLINLAV
Gm16g06190       EKVSYIESLDYEINENDLFKHDWRSRSRVQVLQYIFLKWLLAFLVGLLTGIIATLINLAV
Gm_TC286373      AKVSYIESLDYEINENDLFKQDWRSRSRTQVLQYIFWKWTLAFLVGLLTGVIATLINLAV
Gm05g14760       AKVSYIESLDYEINENDLFKQDWRSRSRTQVLQYIFWKWTLAFLVGLLTGVIATLINLAV
Os_TC285852      AKVSHIESLDYEIIENDLFKHDWRRRSNVEVLQYIFLKWAMAFLVGLLTGVIASLINLAI
Os03g48940_1     LFAGGVESLDYEVIENYAYREEQAQRSKFWVPYYVMLKWLFSLLIGVGTGLAAIFINLAV
Os_TC299772      LFAGGVESLDYEVIENYAYREEQAQRSKFWVPYYVMLKWLFSLLIGVGTGLDAIFINLAV
Os03g48940_2     LFAGGVESLDYEVIENYAYREEQAQRSKFWVPYYVMLKWLFSLLIGVGTGLAAIFINLAV
Gm01g44950       ----GGVESLDYEVIENFAYREEQAQRGKLYVSYLLVVKWFFALLIGICTGLAAVFINIAV
Gm11g00690       ----GGVESLDYEVIENFAYREEQAQRGKLYVSYLLVVKWFFALLIGICTGLAAVVINIAV
AT5G26240        ----GGVNSLDYEVTENYAYREEQAHRGKLYVGYYVAVKWFFSLLIGIGTGLAAVFINLSV
Pp_151168        ----GMESLDYEVVESVAYREDQAQRGIWHHASYITLKWTFSLLIGIGTGLAAFLINIAV
Pp_105025        TRVAPIESLDYELVENELFRQDWRSRKKREILQYVAVKWTFVFLVGILTAIAALGINTAV
                     : ****: *.  ::.:   *        :  ** :  *:*: *.:  **  ::

AT5g40890        ENIAGYKLLAVGYYIAQDRFWTGLMVFTGANLGLTLVATVLVVYFAPTAAGPGIPEIKAY
AT3G27170        ENIAGYKLLAVGHFLTQERYVTGLMVLVGANLGLTLVASVLCVCFAPTAAGPGIPEIKAY
Pt_829777        ENIAGYKILAVVHFIENKRYLTGLVYFTGANLLLTLFASVLCVCFAPTAAGPGIPEIKAY
Gm19g25680_2     ENIAGYKLLAVLKYIHKERYLTGFLYFTGINFVLTFVAAILCVCFAPTAAGPGIPEIKAY
Gm19g25680_1     ENIAGYKLLAVLKYIHKERYLTGFLYFTGINFVLTFVAAILCVCFAPTAAGPGIPEIKAY
Gm16g06190       ENIAGYKLLAVLKYIHKERYLTGFLYFTGINFVLTFVAAILCVCFAPTAAGPGIPEIKAY
Gm_TC286373      ENIAGYKFLAVVNFIQKERYLRGFLYFTGINFLLTFVASILCVCFAPTAAGPGIPEIKAY
Gm05g14760       ENIAGYKFLAVVNFIQKERYLRGFLYFTGINFLLTFVASILCVCFAPTAAGPGIPEIKAY
Os_TC285852      ENISGLKMLHMVQLVRKKRYWAGFLYFAGVNFGLTFIAAMLCVVFAPTAAGPGIPEIKAY
Os03g48940_1     ENFSGWKYAATFAIIQHSYFVG-FFVYIVFNLALVFSSVYIVTNFAPAAAGSGIPEIKGY
Os_TC299772      ENFSGWKYAATFAIIQHSYFVG-FFVYIVFNLALVFSSVYIVTNFAPAAAGSGIPEIKGY
Os03g48940_2     ENFSGWKYAATFAIIQHSYFVG-FFVYIVFNLALVFSSVYIVTNFAPAAAGSGIPEIKGY
Gm01g44950       ENFAGWKFSVTFNIIQKSYIAG-FVVYVLINLALVFSSVYIITQFAPAAAGSGIPEIKGY
Gm11g00690       ENFAGWKFSVTFNIIQKSYIAG-FVVYVLINLALVFSSVYIITQFAPAAAGSGIPEIKGY
AT5G26240        ENFAGWKFALTFAIIQKSYFAG-FIVYLLINLVLVFSSAYIITQFAPAAAGSGIPEIKGY
Pp_151168        ENFSGWKFAATFALMKYSTFLG-LVIYIAFNAALVFSSVYIITQFAPAAAGSGIPEIKAY
Pp_105025        ENIAGVKFLLTVKFMESNRFVWAFLVYAGFNVMLVMSAALLCVYIGPSAAGSGIPEVKAY
                 **::* *    :  . :.   *  *.: :  : ..:*:***.****:*.*
```

FIGURE 2

```
AT5g40890       LNGIDTPNMFGFTTMMVK---IVGSIGAVAAGLDLGKEGPLVHIGSCIASLLG---QGGP
AT3G27170       LNGVDTPNMFGATTMIVK---IVGSIGAVAAGLDLGKEGPLVHIGSCIASLLG---QGGT
Pt_829777       LNGVDTPNMFGVTTLIVK---IFGSIGAVSAGLDLGKEGPLVHIGSCIASLLG---QGGP
Gm19g25680_2    LNGVDTPNMFGATTLIVK---IIGSIGAVSAGLDLGKEGPLVHIGSCIASLLG---QGGP
Gm19g25680_1    LNGVDTPNMFGATTLIVK---IIGSIGAVSAGLDLGKEGPLVHIGSCIASLLG---QGGP
Gm16g06190      LNGVDTPNMFGATTLIVK---IIGSIGAVSAGLDLGKEGPLVHIGSCIASLLG---QGGP
Gm_TC286373     LNGVDTPNMYGATTLFVK---IIGSIGAVSAGLDLGKEGPLVHIGSCIASLLG---QGGP
Gm05g14760      LNGVDTPNMYGATTLFVK---IIGSIGAVSAGLDLGKEGPLAKEALTITGSSG----AGYG
Os_TC285852     LNGVDTPNMFGAPQLIVK---IIGSICAVSSGLDLGKEGPLVHTGACLANLLS---QGGS
Os03g48940_1    LNGVDTHGILLFRTLVGK---IFGSIGSVGGGLALGKEGPLVHTGACIASLLG---QGGS
Os_TC299772     LNGVDTHGILLFRTLVGK---IFGSIGSVGGGLALGKEGPLVHTGACIASLLG---QGGS
Os03g48940_2    LNGVDTHGILLFRTLVGK---IFGSIGSVGGGLALGKEGPLVHTGACIASLLG---QGGS
Gm01g44950      LNGVDIHGILLFRTLIGK---IFGSIGSVGGGLALGKEGPLVHTGACIASLLG---QGGS
Gm11g00690      LNGVDIHGILLFRTLIGK---IFGSIGSVGGGLALGKEGPLVHTGACIASLLG---QGGS
AT5G26240       LNGIDIPGTLLFRTLIGK---IFGSIGSVGGGLALGKEGPLVHTGACIASLLG---QGGS
Pp_151168       LNGVDTPGILLFRTLIGK---VLGSIGSVGGGLALGKEGPLVHTGACIASVLGQAMQGGS
Pp_105025       LNGVDTPNIFSIKTLVVKATLILGSIGSVAGGLIVGKEGPLVHVGSCIASLLG---QGGS
                ***:*    .        :. *    :.*** :*..** :*****.:  .  ::  .  *

AT5g40890       DNHRIKWRWLRYFNNDRDRRDLITCGSASGVCAAFRSPVGGVLFALEEVATWWRSALLWR
AT3G27170       DNHRIKWRWLRYFNNDRDRRDLITCGSAAGVCAAFRSPVGGVLFALEEVATWWRSALLWR
Pt_829777       DNYRLKWRWLRYFNNDRDRRDIITCGASSGVCAAFRSPVGGVLFALEEVATWWRSALLWR
Gm19g25680_2    DNYRIKWRWLRYFNNDRDRRDLITCGSSSGVCAAFRAPVGGVLFALEEVATWWRSALLWR
Gm19g25680_1    DNYRIKWRWLRYFNNDRDRRDLITCGSSSGVCAAFRAPVGGVLFALEEVATWWRSALLWR
Gm16g06190      DNYRTKWHWLRYFNNDRDRRDLITCGSSSGVCAAFRAPVGGVLFALEEVATWWRSALLWR
Gm_TC286373     DNYRIKWRWLRYFNNDRDRRDLITCGASSGVCAAFRAPVGGVLFALEEVATWWRSALLWR
Gm05g14760      --------------------ISTTIVTVAILLLVAPVGGVLFALEEVATWWRSALLWR
Os_TC285852     GRHRLRLRWLRYFDNDRDRRDLITCGASSGVCAAFRAPVGGVLFALEEVATWWRSALLWR
Os03g48940_1    AKYHLSSRWVRIFESDRDRRDLVTCGCAAGVAAAFRAPVGGVLFALEEVTSWWRSHLMWR
Os_TC299772     AKYHLSSRWVRIFESDRDRRDLVTCGCAAGVAAAFRAPVGGVLFALEEVTSWWRSHLMWR
Os03g48940_2    AKYHLSSRWVRIFESDRDRRDLVTCGCAAGVAAAFRAPVGGVLFALEEVTSWWRSHLMWR
Gm01g44950      TKYHLNSRWFQVFKSDRDRRDLVTCGCAAGVAAAFRAPVGGVLFALEEVTSWWRSQLMWR
Gm11g00690      TKYHLNSRWFQVFKSDRDRRDLVTCGCAAGVAAAFRAPVGGVLFALEEVTSWWRSQLMWR
AT5G26240       TKYHLNSRWPQLFKSDRDRRDLVTCGCAAGVAAAFRAPVGGVLFALEEVTSWWRSQLMWR
Pp_151168       TKYHVNWRWLRRFKNDRDRRDLVTCGCAAGVAAAFRAPVGGVLFALEEVTSWWRSQLLWR
Pp_105025       VKYGLTCKWLRYLKNDRDRRDLVTCGAAAGVAAAFRAPVGGVLFALEEVTSWWRGPLLWR
                 :           :  :  . :  :**********: :***. *:**

AT5g40890       TFFSTAVVVVVLRAFIEICNSGKCGLFGSGGLIMFDVSHEVERYHAADIIPVTLIGVFGG
AT3G27170       TFFSTAVVVVVLREFIEICNSGKCGLFGKGGLIMFDVSHVTYTYHVTDIIPVMLIGVIGG
Pt_829777       TFFSTAVVVVILRTFIEICNSGKCGLFGKGGLIMFDVSDVVVTYHVMDVIPITIIGILGG
Gm19g25680_2    TFFSTAVVVVVLRAFIEICHTGKCGLFGEGGLIMFDVSNVTVRYHVMDIVLVVVIGIIGG
Gm19g25680_1    TFFSTAVVVVVLRAFIEICHTGKCGLFGEGGLIMFDVSNVTVRYHVMDIVLVVVIGIIGG
Gm16g06190      TFFSTAVVVVVLRAFIEICHTGKCGLFGEGGLIMFDVSNVTVRYHVMDIVLVVVIGIIGG
Gm_TC286373     TFFSTAVVVVVLRASIELCHKGKCGLFGEGGLIMYDVSDVTVRYNVMDIIPVVIIGVLGG
Gm05g14760      TFFSTAVVVVVLRASIELCHKGKCGLFGEGGLIMYDVSDVTVRYNVMDIIPVVIIGVLGG
Os_TC285852     TFFSTATVVVVLRGFIEVCRNGRCGLFGEGGLILFDVGDVAVRYHAGDLLPVTIVGVLGG
Os03g48940_1    VFFTSAVVAVVVRSAMNWCKSGKCGHFGSGGFIIWDISGGQEDYSYQELLPMAIIGVIGG
Os_TC299772     VFFTSAVVAVVVRSAMNWCKSGKCGHFGSGGFIIWDISGGQEDYSYQELLPMAIIGVIGG
Os03g48940_2    VFFTSAVVAVVVRSAMNWCKSGKCGHFGSGGFIIWDISGGQEDYSYQELLPMAIIGVIGG
Gm01g44950      VFFTSAVVAVVVRAAMGWCKSGKCGHFGSGGFIIWDISDGQEDYSFAELFPMAIIGVIGG
Gm11g00690      VFFTSAVVAVVVRAAMGWCKSGKCGHFGSGGFIIWDISDGQEDYSFAELFPMAIIGVIGG
AT5G26240       VFFTSAIVAVVVRTAMGWCKSGICGHFGGGGFIIWDVSDGQDDYYFKELLPMAVIGVIGG
Pp_151168       VFFTSAVVAVVVRTAMGWCKHGNCGHFGSGGFIIWDISGGQDDYSFFELLPMAMLGAIGG
Pp_105025       AFFTTAVVAVVIRTGIAWCKQGHCGMAGEGGLIIFDVSGVQESYGLRELSSVAVSGVLGG
                .**::*  *.*::*  :  *. * ** * **:*::*:.      *  ::  : :* :**
```

FIGURE 2 (continued)

```
AT5g40890      ILGSLYNHLLHKVLRLY-NLINQKGKIHKVLLSLGVSLFTSVCLFGLPFLAECKPCDPSI
AT3G27170      ILGSLYNHLLHKVLRLY-NLINEKGKIHKVLLSLTVSLFTSVCLYGLPFLAKCKPCDPSI
Pt_829777      ILGSLYNYLLHKVLVVY-NLINQKGRIHKLLLALTVSIFTSVCLYGLPFLAKCQPCDPSV
Gm19g25680_2   VLGSLYNHVLHKVLRLY-NLIN---------HLAVALFTSMCEYGLPFLAKCTPCDPSL
Gm19g25680_1   VLGSLYNHVLHKVLRLY-NLINQKGRIHKLLLSLAVALFTSMCEYGLPFLAKCTPCDPSL
Gm16g06190     VLGSLYNHVLHKVLRLY-NLINQKGRTHKLLLSLAVALFTSMCQYGLPFLAKCTPCDPSL
Gm_TC286373    VLGSLYNYLLHKVLRVY-NLINQKGKMYKLLLSLSVAIFTSACQYGLPFLAKCTPCDPSL
Gm05g14760     VLGSLYNYLLHKVLRVY-NLINQKGKMYKLLLSLSVAIFTSACQYGLPFLAKCTPCDPSL
Os_TC285852    VLGALYNHVLHKVLRVY-NLINEKGRAAKLALALAVCALTSALLYVTPFAVPCTPCDPAF
Os03g48940_1   LLGALFNQLTLYITKWRRTYLHKKGKRVKIFEACLISLVTSTISFVLPLMRKCSSCPQLE
Os_TC299772    LLGALFNQLTLYITKWRRTYLHKKGKRVKIFEACLISLVTSTISFVLPLMRKCSSCPQLE
Os03g48940_2   LLGALFNQLTLYITKWRRTYLHKKGKRVKIFEACLISLVTSTISFVLPLMRKCSSCPQLE
Gm01g44950     LLGSLFNQLTLYITTWRRNHLHKKGNRVKIIEACLVSILTSAISFGLPLLRKCSPCPDSD
Gm11g00690     LLGSLFNQLTLYITTWRRNHLHKKGSRVKIIEACLVSILTSAISFGLPLLRKCSPCPDSD
AT5G26240      LLGALFNQLTLYMTSWRRNSLHKKGNRVKIIEACIISCITSAISFGLPLLRKCSPCPESV
Pp_151168      LLGALFNQLTIWISTWRRNVLHRRGTRVKIIEVLLVSLITSMLSFGLPMMTTCKPCPDPV
Pp_105025      VLGSLFNQINAKIIVWSGTWLKKKGKFAKIIQAILIALVTSICSFGLPFLAKCQPCPDHL
               :**:*:*  :      :    . ::        :. .**   : *:    * . *

AT5g40890      DE-----ICPTNGRSGNFKQFNCP-NGYYNDLSTLLLTTNDDAVRNIFSSNTPNEFGMVSL
AT3G27170      DE-----ICPTNGRSGNFKQFHCP-KGYYNDLATLLLTTNDDAVRNLFSSNTPNEFGMGSL
Pt_829777      QE-----ICPTNSRSGNFKQFNCP-DGHYNDLATLLFTTNDDAVRNIFSSNALKEFQPASL
Gm19g25680_2   PES----TCPTNGRSGNFKQFNCP-PGYYNDLATLLLTTNDDAVRNIFSTNTPQEYQPLSL
Gm19g25680_1   PES----TCPTNGRSGNFKQFNCP-PGYYNDLATLLLTTNDDAVRNIFSTNTPQEYQPLSL
Gm16g06190     PES----ACPTNGRSGNFKQFNCP-PGYYNDLATLLLTTNDDAVRNIFSTNTPQEYQPLSL
Gm_TC286373    SD-----VCPTNGRSGNFKQFNCP-KGYYNDLATLLLTTNDDAVRNIFSTNTPLEYQPSSI
Gm05g14760     SD-----VCPTNGRSGNFKQFNCP-KGYYNDLATLLLTTNDDAVRNIFSTNTPLEYQPSSI
Os_TC285852    GG-----ACPTLGKSGNFKRFNCP-EGHYNDLATLLHATNVDATRNIFSTGTAGEFRLDSL
Os03g48940_1   TNSGIECPRPPGTDGNFVNFYCSKDNEYNDLATIFFNTQDDAIRNLFSAKTFHEYSAQSL
Os_TC299772    TNSGIECPRPPGTDGNFVNFYCSKDNEYNDLATIFFNTQDDAIRNLFSAKTFHEYSAQSL
Os03g48940_2   TNSGIECPRPPGTDGNFVNFYCSKDNEYNDLATIFFNTQDDAIRNLFSAKTFHEYSAQSL
Gm01g44950     PASGIECPRPPGMYGNYVNFFCSKDKEYNDLATIFFNTQDDAIRNLFSAKTINEYSSQSL
Gm11g00690     LASGIECPRPPGMYGNYVNFFCSKDKEYNDLATIFFNTQDDAIRNLFSAKTINEYSSQSL
AT5G26240      PDSGIECPRPPGMYGNYVNFFCKTDNEYNDLATIFFNTQDDAIRNLFSAKTMREFSAQSL
Pp_151168      KYPSVICPRPSGNYGNYVNFFCPNENQYNDLATIFFNTQDDAIRNLFSTNTPHEYSTRSL
Pp_105025      TIPGEKACPTYGRAGNFKNFHCP-DGSYNDLAGLFFNTNEDSVRNLFSKGTNGEFQFSSL
                  .   **:  .* *    ****: ::  *:  *:  **:**   :    *:     *:

AT5g40890      WIFFGLYCILGLITFGIATPSGLFLPIILMGSAYGRMLGTAMGSYT---NIDQGLYAVLG
AT3G27170      WIFFVLYCILGLFTFGIATPSGLFLPIILMGAAYGRMLGAAMGSYT---SIDQGLYAVLG
Pt_829777      LIFFVLYCILGLFTFGIAVPSGLFLPIILMGSAYGRLLGIAMGSYT---KIDQGLYAVLG
Gm19g25680_2   VIFFVLYCILGLITFGIAVPSGLFLPIILMGSGYGRLLGIYMGPHT---NIDQGLFAVLG
Gm19g25680_1   VIFFVLYCILGLITFGIAVPSGLFLPIILMGSGYGRLLGIYMGPHT---NIDQGLFAVLG
Gm16g06190     VIFFLLYCILGLITFGIAVPSGLFLPIILMGSGYGRLLGIYMGPHT---NIDQGLFAVLG
Gm_TC286373    IIFFALYCILGLITFGIAVPSGLFLPIILMGSGYGRLLGILMGPHT---NIDQGLFAVLG
Gm05g14760     IIFFALYCILGLITFGIAVPSGLFLPIILMGSGYGRLLGILMGPHT---NIDQGLFAVLG
Os_TC285852    LIFFAVYCVLGLFTFGIAVPSGLFLPIILMGSAYGRVTALVLSRFA---RIDHGLYAVLG
Os03g48940_1   ITFLVMFYSLAVVTFGTAVPAGQFVPGIMIGSTYGRLVGMFVVKFYKKLNVEEGTYALLG
Os_TC299772    ITFLVMFYSLAVVTFGTAVPAGQFVPGIMIGSTYGRLVGMFVVKFYKKLNVEEGTYALLG
Os03g48940_2   ITFLVMFYSLAVVTFGTAVPAGQFVPGIMIGSTYGRLVGMFVVKFYKKLNVEEGTYALLG
Gm01g44950     LTFLVMFYALAVVTFGTAVPAGQFVPGIMIGSTYGRLVGMFVVKYYRKLNIEEGTYALLG
Gm11g00690     LTFLVMFYALAVITFGTAVPAGQFVPGIMIGSTYGRLVGMFVVKYYRKLNIEEGTYALLG
AT5G26240      LTFLAMFYTLAVVTFGTAVPAGQFVPGIMIGSTYGRLVGMFVVRFYKKLNIEEGTYALLG
Pp_151168      LTFLVMFFVLAVLTYGTAVPSGQFVPGIMIGATYGRLVGILVVNASSKDSVDEGTYALLG
Pp_105025      FVYLTSAYSLALLTYGTAVPSGLFVPAILCGATYGRIVGMIMGSFYVNGHMDEGVYALLG
               ::     *.:.*:* *.*:*  *:* *: *: *** .  :          ::.* :*:**
```

FIGURE 2 (continued)

```
AT5g40890        AASLMAGSMRMTVSLCVIFLELTNNLLLLPITMFVLLIAKTVGDSFNLSIYEIILHLKGL
AT3G27170        AAALMAGSMRMTVSLCVIFLELTNNLLLLPITMIVLLIAKTVGDSFNPSIYDIILHLKGL
Pt_829777        AASLMAGSMRMTVSLCVIFLELTNNLLLLPITMIVLLISKTVGDSFNPSIYEIILDLKGL
Gm19g25680_2     AASLMAGSMRMTVSLCVIFLELTNNLLLLPITMIVLLIAKTVGDSFNPSIYEIILHLKGL
Gm19g25680_1     AASLMAGSMRMTVSLCVIFLELTNNLLLLPITMIVLLIAKTVGDSFNPSIYEIILHLKGL
Gm16g06190       AASLMAGSMRMTVSLCVIFLELTNNLLLLPITMIVLLIAKTVGDSFNPSIYEIILHLKGL
Gm_TC286373      AASLMAGSMRMTVSLCVIFLELTNNLLLLPITMIVLLIAKTVGDSFNPSIYEIILHLKGL
Gm05g14760       AASLMAGSMRMTVSLCVIFLELTNNLLLLPITMIVLLIAKTVGDSFNPSIYEIILHLKGL
Os_TC285852      AAALMSGSMRMTVSLVVIFLELTNNLLLLPITMFVLLIAKTVGDAFNPSIYEIILDLKGL
Os03g48940_1     AASFLGGSMRMTVSLCVIMVEITNNLKLLPLIMLVLLISKAVGDFFNEGLYEVQAQLRGI
Os_TC299772      AASFLGGSMRMTVSLCVIMVEITNNLKLLPLIMLVLLISKAVGDFFNEGLYEVQAQLRGI
Os03g48940_2     AASFLGGSMRMTVSLCVIMVEITNNLKLLPLIMLVLLISKAVGDFFNEGLYEVQAQLRGT
Gm01g44950       AASFLGGSMRMTVSLCVIMVEISNNLKFLPLIMLVLLISKAVGDAFNEGIYEEQAQLRGI
Gm11g00690       AASFLGGSMRMTVSLCVIMVEISNNLKFLPLIMLVLLISKAVGDAFNEGIYEEQAQLRGI
AT5G26240        AASFLGGSMRMTVSLCVIMVEITNNLKLLPLIMLVLLISKAVGDAFNEGLYEVQARLKGI
Pp_151168        AASFLGGSMRMTVSLCVIMVEITNNLQLLPLIMLVLLISKAVGDAFNSGFYEEQVKLRSL
Pp_105025        AASFLGGSMRMTVSLCIILLELTNNLLLLPLIMLVLLISKTVGDAFNDGLYSLHVHIKGI
                 **:::.*********  :*::*:;***  :**:  *;****:*:***  **  .:*.       :::.:

AT5g40890        PFLEANPEPWMRNLTVGELNDAKPPVVTLNGVEKVANIVDVLRNTTHNAFPVLDGADQN-
AT3G27170        PFLEANPEPWMRNLTVGELGDAKPPVVTLQGVEKVSNIVDVLKNTTHNAFPVLDEAEVP-
Pt_829777        PFLDANPEPWMRNLTVAELADAKPPVVTLCGVEKVSRIVEVLENTTHNGFPVVDEGVVP-
Gm19g25680_2     PFMDANPEPWMRNLTVGELVDVKPSVVTLHGVEKVAKIVDVLKNTTHNAFPVMDDGVVPP
Gm19g25680_1     PFMDANPEPWMRNLTVGELVDVKPSVVTLHGVEKVAKIVDVLKNTTHNAFPVMDDGVVPP
Gm16g06190       PFIDANPEPWMRNLTVGELVDVKPPVVTLHGVEKVAKIVDVLKNTTHNAFPVMDNGVVPP
Gm_TC286373      PFMDANPEPWMRNLTVGELVDVKPAVVSFKGVEKVANIVNALKNTTHNGFPVMDCGLVP-
Gm05g14760       PFMDANPEPWMRNLTVGELVDVKPAVVSFKGVEKVANIVNALKNTTHNGFPVMDCGLVP-
Os_TC285852      PFLEAKPEPWMKDLTVGELAAAKPRAVALQVVERVSTVVEALRATRHNGFPVLDRPRP--
Os03g48940_1     PLLDSRPKQVMRNMSAKDACKN-QKVVSLPRVSRIVDIISVLRSNKHNGFPVVDR--GQ-
Os_TC299772      PLLDSRPKQVMRNMSAKDACKN-QKVVSLPRVSRIVDIISVLRSNKHNGFPVVDR--GQ-
Os03g48940_2     PLLDSRPKQVMRNMSAKDACKN-QKVVSLPRVSRIVDIISVLRSNKHNGFPVVDR--GQ-
Gm01g44950       PLLESRPKYEMRNMTAKEACGS-GRVVSFPRVVKVSDVVSILRSNKHNGFPVIDH--TR-
Gm11g00690       PLLESRPKYEMRNMTAKEACGS-GRVVSFPRVVKVSDVVSILRSNKHNGFPVIDH--TR-
AT5G26240        PLLESRPKYHMRQMIAKEACQS-QKVISLPRVIRVADVASILGSNKHNGFPVIDH--TR-
Pp_151168        PLLESRPQRFMRNLAAKDASGT-RKIVQFSRVSKVGHIVAVLRSTNHNGFPVVDK--LQ-
Pp_105025        PFLEAHPPQFMSHLTARDAIT--RPLIWFSKVERVGTIAEVLRSTNHHAFPVVDDDVEC-
                 *:::::.*      *  .:  . :        :  :  *  ::   *   *.:.***:*

AT5g40890        TG------TELHGLILRAHLVKVLKKRWFLNEKRR-------TEEWEVREKFTPVELAER
AT3G27170        QVGLATGATELHGLILRAHLVKVLKKRWFLTEKRR-------TEEWEVREKFPWDELAER
Pt_829777        LMGLATGATELHGLILRAHLVQVLKKKWFLPEKRR-------TEEWEVREKFDWVELAER
Gm19g25680_2     VVGQANGGTELHGLILRAHLIQALKKKWFLKERRR-------TEEWEVREKFTVVELAER
Gm19g25680_1     VVGQANGGTELHGLILRAHLIQALKKKWFLKERRR-------TEEWEVREKFTVVELAER
Gm16g06190       VVGQANGGTELHGLILRAHLIQAIKKKWFLKERRR-------TEEWEVREKFTVVELAER
Gm_TC286373      TTGVANEATELHGIILRAHLIQVLKKKWFLKERRR-------TEEWEVREKFTWVELAER
Gm05g14760       TTGVANEATELHGIILRAHLIQVLKKKWFLKERRR-------TEEWEVREKFTWVELAER
Os_TC285852      ------GVSELHGLVLRSHLVAALRKRWFLPERRR-------TEEWEAREMFSSAELADK
Os03g48940_1     -----NGESLVIGLILRSHLLVLLQSKVDFQNSPFPCGP---GILNRHNTSDFVKPASSK
Os_TC299772      -----NGESLVIGLILRSHLLVLLQSKVDFQNSPFPCGP---GILNRHNTSDFVKPASSK
Os03g48940_2     -----NGESLVIGLILRSHLLVLLQSKVDFQNSPFPCGP---GILNR-------------
Gm01g44950       -----SGEPLVIGLVLRSHLLVILQSKVDFQHSPLPSDPRGGGRSIRHDSGEFAKPVSSK
Gm11g00690       -----SGEPLVIGLVLRSHLLVILQSKVDFQHSPLPSDPRGGGRSIRHDSGEFAKPVSSK
AT5G26240        -----SGETLVIGLVLRSHLLVLLQSKVDFQHSPLPCDP--SARNIRHSFSEFAKPVSSK
Pp_151168        -----TGEPVVIGLILRSYLLVLLQAKTDFQRTPTLGDTR-DRRNFRYDVRDFTKPVSSK
Pp_105025        -----SGKPVFFGLVLRSHLLVLLK-KKEFAKNRLSRSE---VQSSRVTAAEFAKPGSGK
                      .  .*;:**::*;  ::  :   :  .
```

FIGURE 2 (continued)

```
AT5g40890      EDNFDDVAITSSEMQLYVDLHPLTNTTPYTVVQSMSVAKALVLFRSVGLRHLLVVPKIQA
AT3G27170      EDNFDDVAITSAEMEMYVDLHPLTNTTPYTVMENMSVAKALVLFRQVGLRHLLIVPKIQA
Pt_829777      DGTIEEVAVTRNEMEMYVDLHPLTNTTPYTVVESMSVAKAMVLFRQVGLRHMLILPKYQA
Gm19g25680_2   EGSIEEVAVTSEEMEMFVDLHPLTNTTPFTVLESMSVAKAMVLFRQVGLRHLLVVPKYQA
Gm19g25680_1   EGSIEEVAVTSEEMEMFVDLHPLTNTTPFTVLESMSVAKAMILFRQVGLRHLLVVPKYQA
Gm16g06190     EGSIEEVAVTSEEMEIAREHISPSN-------WDLDPGK------------IYLPKHSD
Gm_TC286373    EGNIEDVAVTKEEMEMFVDLHPLTNTTPFTVLESMSVAKAMVLFRQVGLRHMLVVPKYQA
Gm05g14760     EGNIEDVAVTKEEMEMFVDLHPLTNTTPFTVLESMSVAKAMVLFRQVGLRHMLVVPKYQA
Os_TC285852    CGGVDELEISPEEMGMYVDLHPLTNTTPYTVVETMSVAKAVVLFRSVALRHMLIMPKFQG
Os03g48940_1   GKSIDDIHLTEDELGLYLDLAPFLNPSPYIVPEDMSLAKV--------------------
Os_TC299772    GKSIDDIHLTEDELGLYLDLAPFLNPSPYIVPEDMSLAKVYNLFRQLGLRHIFVVPRPSR
Os03g48940_2   ------------------FVLFYHK-----------------------------------
Gm01g44950     GICIDDIHLSSDDLEMYIDLAPFLNPSPYIVPEDMSLTKVYNLFRQLGLRHLFVVPRPSR
Gm11g00690     GICIDDIHLTSDDLEMYIDLAPFLNPSPYIVPEDMSLTKVYNLFRQLGLRHLFVVPRPSC
AT5G26240      GLCIEDIHLTSDDLEMYIDLAPFLNPSPYVVPEDMSLTKVYNLFRQLGLRHLFVVPRPSR
Pp_151168      GISIYDIDISAQEMEMYIDLQPFVNPTPYIVPEDMSLTKVYNLFRQLGLRHICVVPRPSQ
Pp_105025      GLTISDIELTVVEEEMFLDLTGIANTSPYTVVHTMSLAKAYTLFRQLGLRHLCVMPRASE
                                   :

AT5g40890      SGMSPVIGILTRQDLRAYNILQAFPHLDKHKSGKAR------------------------
AT3G27170      SGMCPVVGILTRQDLRAYNILQAFPLLEKSKGGKTH------------------------
Pt_829777      AGVPPVVGILTRQDLRAHNILLAFPHLQGSKSREKKH-----------------------
Gm19g25680_2   SGVSPVIGILTRQDLLAHNILTVFPHLAISKGREKRN-----------------------
Gm19g25680_1   SGVSPVIGILTRQDLLAHNILTVFPHLAISKGREKRN-----------------------
Gm16g06190     SLSSPGK-I---------------------------------------------------
Gm_TC286373    SGVSPVIGILTRQDLLAYNILTVFPHLAKSKRK---------------------------
Gm05g14760     SGVSPVIGILTRQDLLAYNILTVFPHLAKSKRK---------------------------
Os_TC285852    PEISPIVGILTRQDLIAHNILGAFPHLASKRKTH--------------------------
Os03g48940_1   ------------------------------------------------------------
Os_TC299772    -----VVGLITRQDLLLEENGNNVTTELQSTSVRGQLN-GKMLSGSTHLGHPLLDSIVVE
Os03g48940_2   ------------------------------------------------------------
Gm01g44950     -----VLGLITRKDLLIEDKENVNTLELQSTSVRIPHQNKRLMTRNIDVEHPLLSGLLQN
Gm11g00690     -----VVGLITRKDLLIEDKENVNTLELQSTSVRIPQQNKRLMTRNIDVERPLLNGLLQN
AT5G26240      -----VIGLITRKDLLIEENGESSAVELQQSTS-VRGRYSETATR-MDAARPLLDDLLG-
Pp_151168      -----VVGVITRKDLLPEAS----------------------------------------
Pp_105025      G--QPIIGLLTRHDFMSAYLLNLYPHLRQNNYTKIQAFTSKRDEQL--------------

AT5g40890      ----
AT3G27170      ----
Pt_829777      ----
Gm19g25680_2   ----
Gm19g25680_1   ----
Gm16g06190     ----
Gm_TC286373    ----
Gm05g14760     ----
Os_TC285852    ----
Os03g48940_1   ----
Os_TC299772    E---
Os03g48940_2   ----
Gm01g44950     QIPD
Gm11g00690     QIPD
AT5G26240      ----
Pp_151168      ----
Pp_105025      ----
```

FIGURE 2 (continued)

MARSLAALLLLLVAAAGASHAASPAEMYWKIALPTSPMPGAIRDL
                  ----------------5------

ISPASSAASASKDKEDTVGSVFFLEKDLFPGSKMTLHFTRATAGA
---5-----
           --------------6---------------
                 -------------16--------------

ALLPRGRADSVPFASEKLPEILSQLSIPAGSPTADAMRSTLAVCE
     -------------4------------------
     -------------13---------------  --------8------

AARIASETAPKHKHYCATSLESMVELVASSLGTRDVHAVSTEVVN
              -----------1----------
                 -----------------11-----------------
                 -------------14----------------

RAGPTPRQAYRVEAVRPVPVPGGDMVACHRMPYAYAVFGVHGIKG
       -------9-------             ----------2----------
                 ----------15--------------

AAYTVTLAGADGTMAEAVAACHGDVDGHGVAVAEAYKRLGVAPGK
-  ---10--  -------7--------         -----------3----
                                       ---------12---

VAVCHFLPQDDMLWVRN
----3----------
----12----------

FIGURE 5

```
                                           1                                                 50
          AtRD22_AT5G25610.1#1        (1) --------------------------------------------------
          Brassica_napus_AY293830#1   (1) --------------------------------------------------
       Bruguiera_gymnorhiza_AB062746#1 (1) --------------------------------------------------
              P.trichocarpa_561796#1  (1) --------------------------------------------------
          Gossypium_arboreum_AY641990#1 (1) --------------------------------------------------
           Gossypium_hirsutum_AY343972#1 (1) --------------------------------------------------
           Gossypium_hirsutum_AY072821#1 (1) --------------------------------------------------
          Gossypium_arboreum_AY641991#1 (1) --------------------------------------------------
                Glycine_max_EU679375#1 (1) --------------------------------------------------
         Medicago_truncatula_BT051769#1 (1) --------------------------------------------------
                        Mt_BURP_dist  (1) --------------------------------------------------
   Hordeum_vulgare_subsp_vulgare_AK252727#1 (1) MDLFLPLLSFLLILGGQGSHHASFADAPKMTLTNMETLMAYWEAALPGIP
            Triticum_aestivum_AJ575664#1 (1) --------------------------------------------------
                 Os_BURP_dist_BURP02   (1) --------------------------------------------------
                             OsBURP01  (1) --------------------------------------------------
                             OsBURP06  (1) --------------------------------------------------
                             OsBURP07  (1) --------------------------------------------------
                             OsBURP08  (1) --------------------------------------------------
                             OsBURP05  (1) --------------------------------------------------
                             OsBURP17  (1) -------MDRIFARFFCFLLIAAVSHAADLSPEQYWRSILPNTPMPSSIS
                             OsBURP03  (1) --------------------------------------------------
                    Zea_mays_BT036729#1 (1) --------------------------------------------------
                               Vitis   (1) --------------------------------------------------
                            Consensus  (1)
                                           51                                                100
          AtRD22_AT5G25610.1#1        (1) --------------------------------------------------
          Brassica_napus_AY293830#1   (1) --------------------------------------------------
       Bruguiera_gymnorhiza_AB062746#1 (1) --------------------------------------------------
              P.trichocarpa_561796#1  (1) --------------------------------------------------
          Gossypium_arboreum_AY641990#1 (1) --------------------------------------------------
           Gossypium_hirsutum_AY343972#1 (1) --------------------------------------------------
           Gossypium_hirsutum_AY072821#1 (1) --------------------------------------------------
          Gossypium_arboreum_AY641991#1 (1) --------------------------------------------------
                Glycine_max_EU679375#1 (1) --------------------------------------------------
         Medicago_truncatula_BT051769#1 (1) --------------------------------------------------
                        Mt_BURP_dist  (1) --------------------------------------------------
   Hordeum_vulgare_subsp_vulgare_AK252727#1 (51) IPAAISDLLAQQKGLPKIGPNYERVKSEAGHRENHVHIISQVEDDLKEAH
            Triticum_aestivum_AJ575664#1 (1) --------------------------------------------------
                 Os_BURP_dist_BURP02   (1) --------------------------------------------------
                             OsBURP01  (1) --------------------------------------------------
                             OsBURP06  (1) --------------------------------------------------
                             OsBURP07  (1) --------------------------------------------------
                             OsBURP08  (1) --------------------------------------------------
                             OsBURP05  (1) --------------------------------------------------
                             OsBURP17 (44) QLLNYPYLPAVRLPRRTDAGQRNYKSSVSHVAERSHRVDDGQRNYKLSAL
                             OsBURP03  (1) --------------------------------------------------
                    Zea_mays_BT036729#1 (1) --------------------------------------------------
                               Vitis   (1) --------------------------------------------------
                            Consensus (51)
                                           101                                               150
          AtRD22_AT5G25610.1#1        (1) --------------------------------------------------
          Brassica_napus_AY293830#1   (1) --------------------------------------------------
       Bruguiera_gymnorhiza_AB062746#1 (1) --------------------------------------------------
              P.trichocarpa_561796#1  (1) --------------------------------------------------
          Gossypium_arboreum_AY641990#1 (1) --------------------------------------------------
           Gossypium_hirsutum_AY343972#1 (1) --------------------------------------------------
           Gossypium_hirsutum_AY072821#1 (1) --------------------------------------------------
          Gossypium_arboreum_AY641991#1 (1) --------------------------------------------------
                Glycine_max_EU679375#1 (1) --------------------------------------------------
         Medicago_truncatula_BT051769#1 (1) --------------------------------------------------
                        Mt_BURP_dist  (1) --------------------------------------------------
   Hordeum_vulgare_subsp_vulgare_AK252727#1 (101) GYHGEQGIKKVVMAHEPNIGKHLKRQPFSDGLQAKNYVEEQIAGHRTKIE
            Triticum_aestivum_AJ575664#1 (1) --------------------------------------------------
                 Os_BURP_dist_BURP02   (1) --------------------------------------------------
                             OsBURP01  (1) --------------------------------------------------
                             OsBURP06  (1) --------------------------------------------------
                             OsBURP07  (1) --------------------------------------------------
                             OsBURP08  (1) --------------------------------------------------
                             OsBURP05  (1) --------------------------------------------------
                             OsBURP17 (94) PATNELPHRTDAGQRNYKSSVSPVAELPHRVDDGQRNYKLSALPATNELP
                             OsBURP03  (1) --------------------------------------------------
                    Zea_mays_BT036729#1 (1) --------------------------------------------------
                               Vitis   (1) --------------------------------------------------
                            Consensus (101)
```

FIGURE 6

```
                                            151                                           200
              AtRD22_AT5G25610.1#1     (1)  --------------------------------------------------
           Brassica_napus_AY293830#1   (1)  --------------------------------------------------
       Bruguiera_gymnorhiza_AB062746#1 (1)  --------------------------------------------------
                 P.trichocarpa_561796#1 (1) --------------------------------------------------
          Gossypium_arboreum_AY641990#1 (1) --------------------------------------------------
          Gossypium_hirsutum_AY343972#1 (1) --------------------------------------------------
          Gossypium_hirsutum_AY072821#1 (1) --------------------------------------------------
          Gossypium_arboreum_AY641991#1 (1) --------------------------------------------------
                Glycine_max_EU679375#1 (1)  --------------------------------------------------
         Medicago_truncatula_BT051769#1 (1) --------------------------------------------------
                            Mt_BURP_dist (1) -------------------------------------------------
Hordeum_vulgare_subsp_vulgare_AK252727#1 (151) ENLKEISVSYGSEGDHNYKKVPLNLKKIVAAYTPLKDKSLKEISVSYGLK
           Triticum_aestivum_AJ575664#1 (1)  --------------------------------------------------
                    Os_BURP_dist_BURP02 (1)  --------------------------------------------------
                               OsBURP01 (1)  --------------------------------------------------
                               OsBURP06 (1)  --------------------------------------------------
                               OsBURP07 (1)  --------------------------------------------------
                               OsBURP08 (1)  --------------------------------------------------
                               OsBURP05 (1)  ---------------------------------MWHPKSALKLPR---GGR
                               OsBURP17 (144) ERTDAGQRNYKSSVSPXAELXHRVDDXQRNYKLSALPATNELPHXTDAGQ
                               OsBURP03 (1)  --------------------------------------------------
                    Zea_mays_BT036729#1 (1)  --------------------------------------------------
                                  Vitis (1)  --------------------------------------------------
                              Consensus (151)

201                                           250
              AtRD22_AT5G25610.1#1     (1)  -----------------------------------------MAIRLPLICLL
           Brassica_napus_AY293830#1   (1)  -----------------------------------------MAIRLSLICLL
       Bruguiera_gymnorhiza_AB062746#1 (1)  -----------------------------------------MESRIPYILGL
                 P.trichocarpa_561796#1 (1) -----------------------------------------MEFHLTRILAF
          Gossypium_arboreum_AY641990#1 (1) -----------------------------------------MKVLSPILAC
          Gossypium_hirsutum_AY343972#1 (1) -----------------------------------------MKVLSPILAC
          Gossypium_hirsutum_AY072821#1 (1) -----------------------------------------MKVLSPILAC
          Gossypium_arboreum_AY641991#1 (1) -----------------------------------------MKVLSPILAC
                Glycine_max_EU679375#1 (1)  -----------------------------------------MVFPLLSIFALL
         Medicago_truncatula_BT051769#1 (1) -----------------------------------------MDFHLVHIITFF
                            Mt_BURP_dist (1) -----------------------------------------MKFAYISIFISL
Hordeum_vulgare_subsp_vulgare_AK252727#1 (201) VGEAHKEVSGSYGLESENNLKEISLSYGVNSDDTPKEESPHEENVNEISV
           Triticum_aestivum_AJ575664#1 (1)  ------------------------------MARFLVALLAATLVAV
                    Os_BURP_dist_BURP02 (1)  -----------------------------------MARSLAALLLL
                               OsBURP01 (1)  -----------------------------------MARSLAAVLLL
                               OsBURP06 (1)  -----------------------------------------
                               OsBURP07 (1)  -----------------------------------MARSLAALLLL
                               OsBURP08 (1)  -----------------------------------MHTYRSLYRLASTETE
                               OsBURP05 (16) R---GDEDPQKKR-----------------NPLPQ--RPHVRMHVDAF
                               OsBURP17 (194) RNYKSSVSPMAELXHRVDDGQRNYKLSALPATNELPHXTDAGQRNYKSSV
                               OsBURP03 (1)  -----------------------------------MDRLLACLLG--F
                    Zea_mays_BT036729#1 (1)  -----------------------------------MERLLAGLLLGFL
                                  Vitis (1)  -----------------------------------MEFYLLPILAF
                              Consensus (201)                                   LS  IL  L 251                                           300
              AtRD22_AT5G25610.1#1     (12) GSFMVVAIAADLTPERYWSTALPNTPIPNSLHNLLTFDFTD---------
           Brassica_napus_AY293830#1   (12) VS--VTAIAADLTPERYWNSALPNTPIPNSLRHLFTSDFSD---------
       Bruguiera_gymnorhiza_AB062746#1 (12) LMLALVASGAALAPEAYWNSVLPNTPMPKAIRDLLHPDMLE---------
                 P.trichocarpa_561796#1 (12) LSFALVVSHAALPPELYWNSVLPNTPMPKSVRDLLHPDLVE---------
          Gossypium_arboreum_AY641990#1 (11) LALAVVVSHAALSPEQYWSYKLPNTPMPKAVKEILHPELME---------
          Gossypium_hirsutum_AY343972#1 (11) LALAVVVSHAVLSPEQYWSYKLPNIPMPKAVKEILHPELME---------
          Gossypium_hirsutum_AY072821#1 (11) LALAVVVSHAALSPEQYWSYKLPNTPMPKAVKEILHPELME---------
          Gossypium_arboreum_AY641991#1 (11) LALAVVVSHAALSPEQYWSYKLPNTPMPKAVKEILHPELME---------
                Glycine_max_EU679375#1 (13) NLAVVATHAETLPPEVYWKSKLPTTPMPKAITDILHPDLAE---------
         Medicago_truncatula_BT051769#1 (13) MLVVGATNAVMLPPQLYWKSMLPNSPMPKAITNLLHPAGYW---------
                            Mt_BURP_dist (13) SLALVAT-HATLPFELYWKSKLPTTQIFKAITDILHPMDDG---------
Hordeum_vulgare_subsp_vulgare_AK252727#1 (251) SYGLEGSKSLKKVPLNLKEILVAHTPWKDGNLKEISVSYGSKGQEISKEA
           Triticum_aestivum_AJ575664#1 (17) QAGGQLGHAAPATGEVFWRAVLPHSPLPDAVLRLLKQPAAESTSFVR---
                    Os_BURP_dist_BURP02 (12) LVAAAGASHAASPAEMYWKIALPTSPMPGAIRDLISPASSAASASK----
                               OsBURP01 (12) LVAAAGASHAASPAEMYWKIALPTSPMPGAIRDLISPASSVGSAS-----
                               OsBURP06 (1)  -----------------MPGAIRDLINPVSSAASAS-----
                               OsBURP07 (12) LVAAAGDSHAASPAEMYWKIALFTSPMPGAIRDLINPASSAGSAS-----
                               OsBURP08 (17) GVAAARASHAASPAELYWKIALPTSPMPGAIRDLINPARSASQEDT----
                               OsBURP05 (42) LPCLAAGLPSNQG-FTLIRFFFCYLDRLSGVNDLMCATLCTLLDEISILI
                               OsBURP17 (244) SPVAELPHRVDDGQRNYKLSALPATNELPHRTDAGQRNYKSSVSPVAELP
                               OsBURP03 (12) LLIASVGSHAARTPEQYWKSALPNSPIPSSLSQLLSTAGGGTSVNVCGGG
                    Zea_mays_BT036729#1 (14) LLIASVGSHATRAPDQYWKSALPDTPMPSSLSQLLNTPAG--KGGVGGG-
                                  Vitis (12) LSLTLTAGDADLPSEVYWSSVLPNTPMPQAVKNSLRPDLLE---------
                              Consensus (251) L  A  ASHA L PE YWK  LP TPMP AIRDLL P
```

FIGURE 6 (continued)

```
                                              301                                               350
         AtRD22_AT5G25610.1#1    (53)  --------------------------------EKSTNVQVGKGGVNVNTH
         Brassica_napus_AY293830#1 (51)  --------------------------------EESTNVQVGKGGVNVYTG
      Bruguiera_gymnorhiza_AB062746#1 (53) --------------------------------DKGTSVAVGKGGVNVDAG
             P.trichocarpa_561796#1 (53)  --------------------------------DKSTSVAVGKGGVNVDAG
         Gossypium_arboreum_AY641990#1 (52) --------------------------------EKSTSVNVGGGGVNVNTG
         Gossypium_hirsutum_AY343972#1 (52) --------------------------------EKSTSVNVGGGGVNVNTG
         Gossypium_hirsutum_AY072821#1 (52) --------------------------------EKSTSVNVGGGGVNVNTG
         Gossypium_arboreum_AY641991#1 (52) --------------------------------EKSTSVNVGGGGVNVNTG
              Glycine_max_EU679375#1 (54) --------------------------------DKSTSVAVGKGGVNVNAG
         Medicago_truncatula_BT051769#1 (54) --------------------------------SEEK-------------
                        Mt_BURP_dist (53) --------------------------------RISV-------------
   Hordeum_vulgare_subsp_vulgare_AK252727#1 (301) KGIFGLKGEK--------DLKEISVSYGVDDHENMKEISVTYGSKDQETL
              Triticum_aestivum_AJ575664#1 (64) --------------------------------DPEDRPPFDYRDYSRSSS
                   Os_BURP_dist_BURP02 (58) --------------------------------------------------
                               OsBURP01 (57) --------------------------------------------------
                               OsBURP06 (20) --------------------------------------------------
                               OsBURP07 (57) --------------------------------------------------
                               OsBURP08 (63) --------------------------------------------------
                               OsBURP05 (91) LMLLLI---------------------QLEIRVSAAQGGGSHAAM
                               OsBURP17 (294) HRVDDG---------------------QRNYKLSALPATNELPHR
                               OsBURP03 (62) VEVDAGHGKPGGTTVDVGKGGVGVNVKPGYGKFGGTTVGVGKGGVGVNVK
                       Zea_mays_BT036729#1 (61) -----SSGK---------------------KPGGTTVGVGKGGVGVNVN
                                  Vitis (53) --------------------------------DQSTPVEIGKG---TSMG
                              Consensus (301)                              E   T V VG GG   V
                                             351                                               400
         AtRD22_AT5G25610.1#1    (71)  KGKTGS---------------------GTAVNVGKGGVRVDTGKGK-PGGG
         Brassica_napus_AY293830#1 (69)  KGKPGG---------------------GTAVNVGKGGVHVNTGKGK----G
      Bruguiera_gymnorhiza_AB062746#1 (71) KGKPG-------------------------------------------GG
             P.trichocarpa_561796#1 (71) KGKPGGTAVNVGKGGVSVDAGKGKPGGTNVNAGKGGVNVDAGKGK-PGSG
         Gossypium_arboreum_AY641990#1 (70) KGK---------------------------------------PGGD
         Gossypium_hirsutum_AY343972#1 (70) KGK---------------------------------------PGGD
         Gossypium_hirsutum_AY072821#1 (70) KGK---------------------------------------PGGD
         Gossypium_arboreum_AY641991#1 (70) KGKPAG--------------------GTHVNVGRKGVGVNTGK-PGGG
              Glycine_max_EU679375#1 (72) KTKP--------------------------------------------GG
         Medicago_truncatula_BT051769#1 (58) -----------------------------------------------G
                        Mt_BURP_dist (57) -----------------------------------------------D
   Hordeum_vulgare_subsp_vulgare_AK252727#1 (343) KESSGSYGFEGKKDLKEISVSYGAGGHENLKEISVSYGSKDQKNHKEGEG
              Triticum_aestivum_AJ575664#1 (82) DDE-----------------------------------------------P
                   Os_BURP_dist_BURP02 (58) --------------------------------------------------
                               OsBURP01 (57) --------------------------------------------------
                               OsBURP06 (20) --------------------------------------------------
                               OsBURP07 (57) --------------------------------------------------
                               OsBURP08 (63) --------------------------------------------------
                               OsBURP05 (115) SPE----------------------------------QYWRSILPDSTP
                               OsBURP17 (318) IDAGQR-------------------------------NYKSSVSPMAEL
                               OsBURP03 (112) PGYGKPGG-------------------TSVGVGKGGVGVNVQPGYGKPGG
                       Zea_mays_BT036729#1 (84) PTK--PG----------------------------G-----------AG
                                  Vitis (68) FSK--------------------------------------------EGGA
                              Consensus (351)
                                             401                                               450
         AtRD22_AT5G25610.1#1    (100) THVSVGSGKGHGGGVAVHTGKPGKRTDVGVGKGGVTVHTRHKGRPIYVGV
         Brassica_napus_AY293830#1 (95)  THVSVSGGKGHGGGVCVHTGKPGKRTDVGVGKGGVIVHTRHKGKPVYVGV
      Bruguiera_gymnorhiza_AB062746#1 (78) THVGVGGKG-----VGVDAGKPG-------GGG------TNFGFDRAVSN
             P.trichocarpa_561796#1 (120) THVSVGGKG-----VGVAAGKPGKRTDVGVGKGGVSVSKGHHGKPVIVGV
         Gossypium_arboreum_AY641990#1 (77) THVNVGGKG-----VGVNTGKPG-------GGTHVNDP------------
         Gossypium_hirsutum_AY343972#1 (77) THVNVGGKG-----VGVNTGKPG-------GGTHVNDP------------
         Gossypium_hirsutum_AY072821#1 (77) THVNVGGKG-----VGVNTGKPG-------GGTHVNVG------------
         Gossypium_arboreum_AY641991#1 (97) THVNVGGKG-----VGVNTGKPG-------GGTHVNVGGKGGGVSVHTGH
              Glycine_max_EU679375#1 (78) TSVNVGKGG-----VNVNTGKGK-----PNKGTSVNVGKGGVNVNTGPKK
         Medicago_truncatula_BT051769#1 (59) TWVDVGKGG-----VDVGVRKGYY----EGGGTDVNVGVG----------
                        Mt_BURP_dist (58) GKISVN--------------------------GKTRIVYDA---------
   Hordeum_vulgare_subsp_vulgare_AK252727#1 (393) SYALKGETDIKEISVSYGVDSQEFVKG---LSPSHEENPREVTISYGSIE
              Triticum_aestivum_AJ575664#1 (86) SKSTVAASGAGGFDYDNYSGADER------RGATDEYKAP----------
                   Os_BURP_dist_BURP02 (58) --------------------------------------------------
                               OsBURP01 (57) --------------------------------------------------
                               OsBURP06 (20) --------------------------------------------------
                               OsBURP07 (57) --------------------------------------------------
                               OsBURP08 (63) --------------------------------------------------
                               OsBURP05 (130) MPISISQLLGDGYPYSPAVGLPKR-----GDRVQIRYGPNIY--------
                               OsBURP17 (336) PHRADDGQRNYKLSVSPAAELPHR-----VDDGQRNYKLSVLPATELVHY
                               OsBURP03 (143) TTVGVGKGG---VGVNVQPGYGKP------GGTTVGVGKGGVGVNVKPRG
                       Zea_mays_BT036729#1 (92) TTVGVGKGG---VGVGVNPGYGKP------GGTTVGVGKGRVGVHVNPGK
                                  Vitis (75) MNMYAGVK-------------------PAKAA------------------
                              Consensus (401) T  V  VG         V  V   G                    V
```

FIGURE 6 (continued)

```
                                        451                                               500
         AtRD22_AT5G25610.1#1    (150)  KPG-------ANPFVYNYAAKETQLHDDPNAALFFLEKDLVRGK---EMNV
         Brassica_napus_AY293830#1 (145) KPG-------HNPFAYNYAASETQLHDDPKAALFFLEKDMVPGK---AMNL
      Bruguiera_gymnorhiza_AB062746#1 (110) ----------------IYAASEDQIHDNPNLALFFLQKDLKPGK---SMNL
              P.trichocarpa_561796#1 (165) RPGP------GPFNYIYAATETQLHDDPNVALFFLEKDMHPGK---IMNL
         Gossypium_arboreum_AY641990#1 (103) ----------DPFNYLYAASETQIHEDPNVALFFLEKDMHPGA---TMSL
         Gossypium_hirsutum_AY343972#1 (103) ----------DPFNYLYAASETQIHEDPNVALFFLEKDMHPGA---TMSL
         Gossypium_hirsutum_AY072821#1 (103) ----------DPFNYLYAASETQIHEDPNVALFFLEKDMHPGA---TMSL
         Gossypium_arboreum_AY641991#1 (135) KGKPVNVN--VSPFLYQYAASETQIHDDPNVALFFLEKDLHPGA---TMSL
                Glycine_max_EU679375#1 (118) GKPVHVGVGPHSPFDYNYAASETQWHDDPNVALFFLEKDLHYGT---KLNL
           Medicago_truncatula_BT051769#1 (90) ----------RSPFIYNYAASETQLHDKPNVALFFLEKDLHHGT---KLNL
                           Mt_BURP_dist (73) ----------APIYFYENDANEAELHDNRNLAMFLLEKDLHGT----KFNI
     Hordeum_vulgare_subsp_vulgare_AK252727#1 (440) DKDEQVDALHKVKGEGSHHVETHSYKNKKEADVFFFQDMLRPGS---LITP
              Triticum_aestivum_AJ575664#1 (120) ----------SSSLAGSGAYMARGGKAETTTVPFHEEAVRVGR---RLPF
                        Os_BURP_dist_BURP02 (58) --------------------DKEDTVG--SVFFLEKDLFPGS----KMTL
                                   OsBURP01 (57) --------------------KEDTVG--NVFFLEKDLFPGS----KMTL
                                   OsBURP06 (20) --------------------KEDTVN--NVFFLEKDLFPGS----KMTL
                                   OsBURP07 (57) --------------------KEDTVG--NVFFLEKDLFPGS----KLTL
                                   OsBURP08 (63) --------------------DMDEVSTD--AVFFLEKDLFPGS----KITL
                                   OsBURP05 (167) -----------------GLAASQQFFKDPTMGLFFLETNLQSSK---SIRL
                                   OsBURP17 (381) TDG--------QRNYKSSVLETPELLKDPDMALFFLEKNLQQGKKINNAL
                                   OsBURP03 (184) KP----VHVNVAPFIYNYAATETQLHDDPNVALFFLEKDLHPGK---TMAV
                   Zea_mays_BT036729#1 (133) KP----VHVPVGPFQYEYAASETQLHDDPSVALFFREEDLQPGK---KTTV
                                     Vitis (88) ----------MPFSYHYAATKDQLHAYPNVAIFFLEKDMHPGM---KLTL
                                  Consensus (451)          PF Y YAASE QLHDDPNVALFFLEKDL PG    MTL
                                        501                                               550
         AtRD22_AT5G25610.1#1    (191)  RFNAEDGYG-GKTAFLPRGEAETVPFGSEKFSETLKRFSVEAGSEEAEMM
         Brassica_napus_AY293830#1 (186) RFNAEDGYN-GKTAFLPRGEAETVPFGSEKSSEILNTFSVKPGSGEAEMM
      Bruguiera_gymnorhiza_AB062746#1 (142) DFPESSN----TATFLPRHVADSIPFSSNKLQDAFREFSVKPGSLEAEIM
              P.trichocarpa_561796#1 (206) QFTENTN----TATFLPRQVADSIPFSSDKLPEIYSEFSVKPGSMEAAEM
         Gossypium_arboreum_AY641990#1 (140) HFIENTE----KSAFLPYQTAPKNTFSSDKLPEIFNKFSVKPGSVKAEMM
         Gossypium_hirsutum_AY343972#1 (140) HFTENTE----KSAFLPYQTAQKIPFSSDKLPEIFNKFSVKPGSVKAEMM
         Gossypium_hirsutum_AY072821#1 (140) HFTENTE----KSAFLPYQTAQKIPFSSDKLPEIFNKFSVKPGSLKAEMM
         Gossypium_arboreum_AY641991#1 (181) HFTENTE----KSAFLPYQTAQKIPFSSNELPEIFNKFSVKPGSVKAEMM
                Glycine_max_EU679375#1 (166) HFTRYFTSS-VDASFLPRSVADSIPFSSSNKVNEVLNKFSIKEGSDEAQTV
           Medicago_truncatula_BT051769#1 (128) QFS--KTTS-NAATFLPRQVANSIPFSSNKMEYIINKLNIKKGSKGVQIV
                           Mt_BURP_dist (111) QFT--KTSD-HGPTFLPGDVANSIPFSSNKLENILNYFSIKQGSTESEIV
     Hordeum_vulgare_subsp_vulgare_AK252727#1 (488) TIPPTTSMP----ALLSGDVADSIPFSAEHLSDIITMFAPASLAMTR-EI
              Triticum_aestivum_AJ575664#1 (157) HFPPATPAA---LGFLPRQVADSVPFTTAALPGILATFGIASDSTTVPSM
                        Os_BURP_dist_BURP02 (82) HFTRATAG----AALLPRGRADSVPFASERLPEILSQLSIPACSPTADAM
                                   OsBURP01 (80) HFTRATAG----AALLPRGRADSVPFASERLPEILSQLSIPAVSPTADAM
                                   OsBURP06 (43) HFTRATAG----AALLPRGRADSVPFASEKLPEILSQLSVPAGSPAADAM
                                   OsBURP07 (80) HFTRATAG----AALLPRGRADSVPLATEKLPEILSQLS----------
                                   OsBURP08 (88) HFTRGGAC----AMVLLRGRADAIPFASEKLPEILTQLSVPAGSRAAEDM
                                   OsBURP05 (198) HFANMMAGT----KFLPRGEADAVPFSSKDLQELLAREFGVRPCSVDASVV
                                   OsBURP17 (423) HFANLLATTN--SKFLPRGKADSIPFSSKELPEILDRFGVRPCSDDAAEM
                                   OsBURP03 (228) HFT---ATT-AGEKFLPRSEADAMPFSSEKVPEILSRFSVKPGSVEAAEM
                   Zea_mays_BT036729#1 (177) QFAN--TAM-AGAKFLPRSDAEAIPFSSEKVPEILGRFSVDPDSVEAAEM
                                     Vitis (125) HFTKTT-----NATFLPHQVANSLPFSSDKLAEILDQLSIKPESVEAETI
                                  Consensus (501) HFT  T    AAFLPR ADSIPFSSEKLPEIL FSVKPGS  AE M
                                        551                                               600
         AtRD22_AT5G25610.1#1    (240)  KKTIEECEARKVSGEEK-----YCATSLESMVDFSVSKLGKYHVRAVSTE
         Brassica_napus_AY293830#1 (235) KKTIEECEAKRVGGEEK-----YCATSLESMVDFSVSKLGKDHVRAVSTE
      Bruguiera_gymnorhiza_AB062746#1 (188) ENTVKECENPGIEGEEK-----YCATSLESMVDFSTSKLG-KDIQAISTE
              P.trichocarpa_561796#1 (252) ENTIKECESPGIKGEEK-----YCATSLESMIDFSTSKLG-KNVQAISTE
         Gossypium_arboreum_AY641990#1 (186) KNTIKECEQPAIEGEEK-----YCATSLESMIDYSISKLG-KVDQAVSTE
         Gossypium_hirsutum_AY343972#1 (186) KNTIKECEQPAIEGEEK-----YCATSLESMIDYSISKLG-KVDQAVSTE
         Gossypium_hirsutum_AY072821#1 (186) KNTIKECEQPAIEGEEK-----YCATSLESMIDYSISKLG-KVDQAVSTE
         Gossypium_arboreum_AY641991#1 (227) KNTIKECEQPAIEGEEK-----YCATSLESMIDYSISKLG-KVDQAVSTE
                Glycine_max_EU679375#1 (215) KNTISECEVPGIKGEEK-----RCVTSLESMVDFATTKLGSKDVDAVSTE
           Medicago_truncatula_BT051769#1 (175) KNTISECEEQGIKGEEK-----VCVTSLESMVDFTTSKLG-KNVEAVSTE
                           Mt_BURP_dist (158) KNTISECEAYGIKGEEK-----LCVTSLESMIDFTTLKLG-NNVDTVSTE
     Hordeum_vulgare_subsp_vulgare_AK252727#1 (533) RWTLDTCEHPRTLPGQK-----AGCATSLESLAELPASLLGRRNIRAFSAM
              Triticum_aestivum_AJ575664#1 (204) EATLRACESPTIAGESK-----FCATSLEALVERAMGVLGTRDIRPVTST
                        Os_BURP_dist_BURP02 (128) RSTLAVCEAARIASETAPKHKHYCATSLESMVELVASSLGTRDVHAVSTE
                                   OsBURP01 (126) WSTLAECEAARLAGETT-KHKHYCATSLESMVEFVASSLGTRDVHAVSTE
                                   OsBURP06 (89) RSTLAECEAAPQAGEAK-----RCATSLESMVEFAASSLGTRDVHAVSTE
                                   OsBURP07 (115) ------CEAAPLAGEAK-----QCATSLESMVEFAASSLGTRDVHAVSTE
                                   OsBURP08 (134) RTTLAECEAALLGARDQAK---HCVTSLESMVEFAASSLGTRDIRAVSTE
                                   OsBURP05 (244) KNTLLECELPANKGEKK-----ACATSLESMVDFVASSLGTRDIKAASTF
                                   OsBURP17 (471) SATLQDCELPANKGERK-----ACATSLESIVDFVTSSPGASDVDAASTV
                                   OsBURP03 (274) AQTLRDCEAPPAQGERK-----ACATSLESMVDFATSSLGTSHVRAASTV
                   Zea_mays_BT036729#1 (224) AQTLHDCEAPAARGERK-----ACATSLESMVDFATASLGTSHVRAASTV
                                     Vitis (170) KNTIEECEDPGIKGEEK-----YCATSLESMIDFSTSKLGNKGVKAVSTE
                                  Consensus (551) KNTI  ECEAPAI GEEK     YCATSLESMVDFS SKLG K V AVSTE
```

FIGURE 6 (continued)

```
                                            601                                               650
           AtRD22_AT5G25610.1#1      (285)  VAKKNAP-----MQKYKIAAAGVKKLSDDK--SVVCHKQKYPFAVFYCHK
           Brassica_napus_AY293830#1 (280)  VAEKNAP-----MQKYRIAAAGVKKLSDDK--SVVCHKQKYPFAVFYCHK
       Bruguiera_gymnorhiza_AB062746#1 (232) VEKQTG------RQKYTIAG--VKKIAGDK--CVVCHKQNYPYAVFYCHS
           P.trichocarpa_561796#1    (296)  VDNQTK------MQKYTIKTG-VKKVAGDK--SVVCHKQNYAYSVFYCHA
           Gossypium_arboreum_AY641990#1 (230) VEKQTP----MQKYTIAAG-VQKMTDDK--AVVCHKQNYAYAVFYCHK
           Gossypium_hirsutum_AY343972#1 (230) VEKQTP----MQKYTIAAG-VQKMTDDK--AVVCHKQNYAYAVFYCHK
           Gossypium_hirsutum_AY072821#1 (230) VEKQTP----MQKYTIAAG-VQKMTDDK--AVVCHKQNYAYAVFYCHK
           Gossypium_arboreum_AY641991#1 (271) VEKQTP----THKYTITAG-VQKMTNDK--AVVCHKQNYAYAVFYCHK
           Glycine_max_EU679375#1    (260)  VTKKDNE-----LQQYTMAPGVKRLGEDKA--SVVCHKENYPYAVFYCHK
           Medicago_truncatula_BT051769#1 (219) VNKES-N---LQQYTIASGVKKLGEKNK--AVVCHKENYPYAVFYCHK
           Mt_BURP_dist              (202)  VNGES-G-----LQQYVIANGVKKMGENN---LVVCHKRNYPYAVFYCHK
           Hordeum_vulgare_subsp_vulgare_AK252727#1 (579) DLPMDAPGTPALRGKYNVTAARKLSGSSSE--VVTCHDLTYPYAVYYCHT
           Triticum_aestivum_AJ575664#1 (249) LPRAGAP----LQTYTVVAVQPVEGGP---VFVACHDEAYPYTVYRCHT
           Os_BURP_dist_BURP02       (178)  VVN-RAG-PTP-RQAYRVEAVRPVP-VPGGD-MVACHRMPYAYAVFGVHG
           OsBURP01                  (175)  VIS-TLT-PTP-RQAYRVEAVRPVA-VPGGD-MVACHGMPYAYAVFGLHG
           OsBURP06                  (134)  VD--RAG-PTP-RQAYRVEAVRPVP-VSGGD-MVACHGMAYAYAVFGCHT
           OsBURP07                  (154)  VD--RAG-PAP-RQAYRVEAVRPVP-VSGGD-MVACHGMAYAYAVFGCHT
           OsBURP08                  (181)  VIGTGAA-ETP-RQEYTVEAVKPVVSVSCCN-MVTCHGMPYAYAVFGCHT
           OsBURP05                  (289)  LVGKDGD-TP--AQEYTVTGARRMAETG---QLIACHPESYPYAVFMCHL
           OsBURP17                  (516)  VLSKAVE-SSSLAQDYTVSGVRRMAGTG---QLIACHPESYPYAVFMCHL
           OsBURP03                  (319)  VGKEGSP-----EQEYTVTAVKRAAAGGDQDQLVACHAEPYAYAVFACHL
           Zea_mays_BT036729#1       (269)  VGREGSP-----RQEYTVTGVKRAGGG----RLVACHAEPYAYAVFACHL
           Vitis                     (215)  AENKS-------QMKYRIAAG-LEKMGGDF--SVVCHKMNYPYAVFYCHK
           Consensus                 (601)  V          Q YTI AG      VVCHK  YAYAVFYCH
                                            651                                               700
           AtRD22_AT5G25610.1#1      (328)  AMMT-TVYAVPLEGENGM----RAKAVAVCHKNTSAWN--PNHLAFKVLK
           Brassica_napus_AY293830#1 (323)  AMMT-SVYAVPLEGENGL----RAKAVAVCHKNTSAWN--PNHLAFKVLK
           Bruguiera_gymnorhiza_AB062746#1 (272) IQST-RAYLVQLKGVDRT----RLQAVAICHTNTSAWN--PKHPAFQVLA
           P.trichocarpa_561796#1    (337)  TQTT-RAYTVPLEGDDGT----KAKAVAVCHTDTSAWN--PKHLAFQVLN
           Gossypium_arboreum_AY641990#1 (271) SETT-RAYMVPLEGAGGT----KAKALAVCHTDTSAWN--PKHLAFQFLK
           Gossypium_hirsutum_AY343972#1 (271) SETT-RAYMVPLEGAGGT----KAQALAVCHTDTSAWN--PKHLAFQFLK
           Gossypium_hirsutum_AY072821#1 (271) SETT-RAYMVPLEGADGT----KAKAVAVCHTDTSAWN--PKHLAFQVLK
           Gossypium_arboreum_AY641991#1 (312) SETT-RAYMVPLEGADGT----KAKAVAVCHTDTSAWN--PKHLAFQVLK
           Glycine_max_EU679375#1    (303)  SENT-KAYSVPLEGADGS----RVKAVAVCHTDTSKWN--PKHLAFQVLK
           Medicago_truncatula_BT051769#1 (261) TDTT-KAYSVPLEGADGS----RVKAIAVCHTDTSEWN--PKHLAFQVLK
           Mt_BURP_dist              (243)  TDAT-KVYSVPLEGADGS----RVKAVAICHSDTSQWS--LKHLAFQVLK
           Hordeum_vulgare_subsp_vulgare_AK252727#1 (627) SSPT-AAYMVTLTSVEEDTSPATMEVMAVCHLDTSLWS--PKNPFFELHK
           Triticum_aestivum_AJ575664#1 (291) TGPS-RAYTVDMEGARGAD---AVTIAAVCHTDTSLWN--PEEHVSFKLLG
           Os_BURP_dist_BURP02       (223)  IKGA-AYTVTLAGADGT----MAEAVAACHGDVDGHGVAVAEAYKR-LG
           OsBURP01                  (220)  LKGA--GGGRVPRGRG--------------RARRGGGGIQEARRGARERG
           OsBURP06                  (178)  TTAA--AYTVTLAGADGT----KAEALAACHTDAAPR---VAEAYKR-LG
           OsBURP07                  (198)  TTAA--AYTVALSGADGT----RAEALAACHADAAPG---VAEAYKR-LG
           OsBURP08                  (228)  TTAT--AYAVTLAGADGT----RAEALATCHGDAFPG---VAEAYER-VG
           OsBURP05                  (333)  TEAT-RAYKASLVGKDGA----AVEAVAVCHTDTAEWN--PKHAAFQVLG
           OsBURP17                  (562)  TEATTRAYKASLVGRDGT----AVEAVAVCHTDTSDWN--PEHAAFKVLG
           OsBURP03                  (364)  TRAT-RAYAVSMAGRDGT----GVEAVAVCHADTAGWN--PKHVAFQVLR
           Zea_mays_BT036729#1       (310)  TQQT-RAYSVSMLGRDGT----AVDAVAVCHADTSGWN--PKHVAFQVLR
           Vitis                     (255)  IQAT-RAYMVPLVGRDGT----KAKAVAVCHANTMEWN--PNHLAFQLLK
           Consensus                 (651)  T  T RAY V L GADGT     RA AVAVCHTDTSAWN   PKHLAFQVLK
                                            701                             730
           AtRD22_AT5G25610.1#1      (371)  VKPGTVPCHFLPETHVVWFSY--------
           Brassica_napus_AY293830#1 (366)  VKPGSVPCHFLPETHVVWFSY--------
           Bruguiera_gymnorhiza_AB062746#1 (315) VKPGTVPICHFLPQSHVVWVPK-------
           P.trichocarpa_561796#1    (380)  VKPGTVPCHFLPODHVVWFSN--------
           Gossypium_arboreum_AY641990#1 (314) VEPGTIPVCHFLPRDHIVWVPK--------
           Gossypium_hirsutum_AY343972#1 (314) VEPGTIPVCHFLPRDHIVWVPK--------
           Gossypium_hirsutum_AY072821#1 (314) VEPGTIPVCHFLPRDHIVWVPK--------
           Gossypium_arboreum_AY641991#1 (355) VEPGTIPVCHFLPRDHIVWVPK--------
           Glycine_max_EU679375#1    (346)  VHPGTVPICHFLPQDHVVFVPK--------
           Medicago_truncatula_BT051769#1 (304) VQPGTVPCHLLPEDHVVWIRK--------
           Mt_BURP_dist              (286)  VQQGTFPVCHILQQGQVVWFSK--------
           Hordeum_vulgare_subsp_vulgare_AK252727#1 (674) VGPGDVAVCHFLTKLSIIWVSVDGHVDAL-
           Triticum_aestivum_AJ575664#1 (335) TKPGGTPVCHLMPYCHIIWAKNVKRSPA--
           Os_BURP_dist_BURP02       (266)  VAPGKVAVCHFLPQDDMLWVRN--------
           OsBURP01                  (254)  HLPLPASGRHDLGAQLN------------
           OsBURP06                  (218)  VAPGSVPVCHFLPQDDMLWVRN--------
           OsBURP07                  (238)  VAPGSVPVCHFLPQDDMLWVRN--------
           OsBURP08                  (268)  VAAGSVPVCHIMPLGDMLWVRN--------
           OsBURP05                  (376)  VKPGTVPCHFVQPDVVWTRRG-------
           OsBURP17                  (606)  VKPGTVPVCHFMQPDAVVWTRRG-------
           OsBURP03                  (407)  VKPGTVPVCHFLPQDHVVWTRSG-------
           Zea_mays_BT036729#1       (353)  VKPGTVPICHFLPQDHVVWTRGG-------
           Vitis                     (298)  VKPGTAPICHFLPEDHVWVAK--------
           Consensus                 (701)  V  PGTVPVCHFLP  DHVVWV
```

FIGURE 6 (continued)

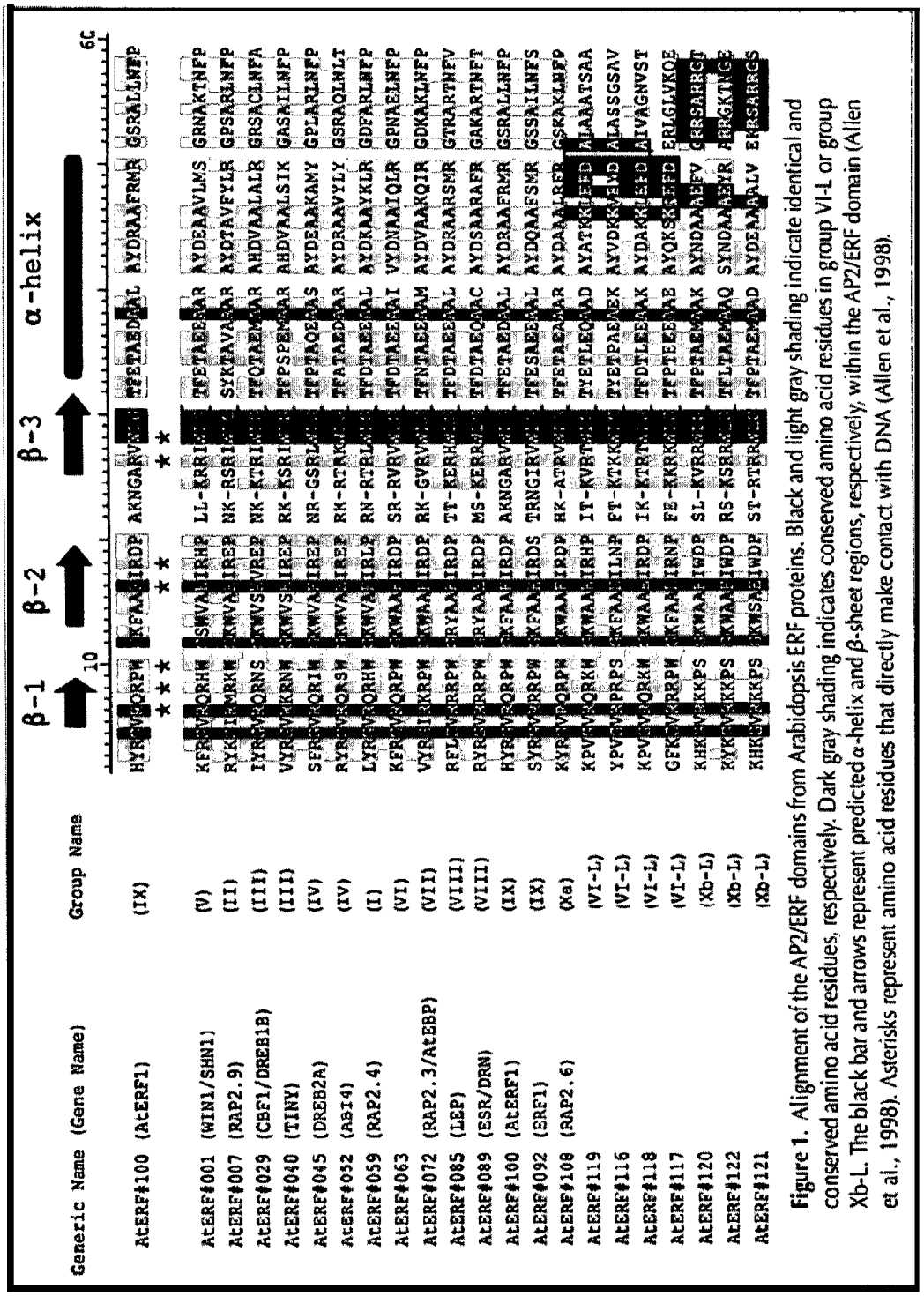

Figure 1. Alignment of the AP2/ERF domains from Arabidopsis ERF proteins. Black and light gray shading indicate identical and conserved amino acid residues, respectively. Dark gray shading indicates conserved amino acid residues in group VI-L or group Xb-L. The black bar and arrows represent predicted α-helix and β-sheet regions, respectively, within the AP2/ERF domain (Allen et al., 1998). Asterisks represent amino acid residues that directly make contact with DNA (Allen et al., 1998).

FIGURE 9

```
Name:  G_max_Glyma17g18580_1                        Len: 401   Check: 3498  Weight: 1.00
Name:  G_max_Glyma05g19050_1                        Len: 401   Check: 7117  Weight: 1.00
Name:  G_max_Glyma01g39540_1                        Len: 401   Check: 6582  Weight: 1.00
Name:  MtAp2ERF_CDS                                 Len: 401   Check:  100  Weight: 1.00
Name:  M_truncatula_TC117996_CDS                    Len: 401   Check:  100  Weight: 1.00
Name:  P_trichocarpa_TC111318                       Len: 401   Check: 7095  Weight: 1.00
Name:  P_trichocarpa_TC91546                        Len: 401   Check: 7196  Weight: 1.00
Name:  P_trichocarpa_CV260432                       Len: 401   Check: 4039  Weight: 1.00
Name:  A_thaliana_AT3G50260_1                       Len: 401   Check: 5349  Weight: 1.00
Name:  B_napus_TC67876                              Len: 401   Check: 9287  Weight: 1.00
Name:  B_napus_BN06MC02259_42032738_2254            Len: 401   Check:  198  Weight: 1.00
Name:  B_napus_TC73559                              Len: 401   Check:  314  Weight: 1.00
Name:  B_napus_TC68928                              Len: 401   Check: 6378  Weight: 1.00
Name:  A_thaliana_AT5G67190_1                       Len: 401   Check: 6844  Weight: 1.00
Name:  B_napus_TC79173                              Len: 401   Check: 3314  Weight: 1.00
Name:  B_napus_TC89313                              Len: 401   Check: 9488  Weight: 1.00
Name:  A_thaliana_AT2G23340_1                       Len: 401   Check: 4289  Weight: 1.00
Name:  B_napus_TC86323                              Len: 401   Check: 4925  Weight: 1.00
Name:  B_napus_TC72792                              Len: 401   Check: 5565  Weight: 1.00
Name:  A_thaliana_AT4G36900_1_CDS                   Len: 401   Check: 3152  Weight: 1.00
Name:  H_annuus_TC30931                             Len: 401   Check: 1434  Weight: 1.00
Name:  H_annuus_TC31134                             Len: 401   Check: 9045  Weight: 1.00
Name:  S_lycopersicum_TC196769_CDS                  Len: 401   Check: 3307  Weight: 1.00
Name:  P_trichocarpa_826816                         Len: 401   Check: 3689  Weight: 1.00
Name:  P_trichocarpa_644094                         Len: 401   Check: 3093  Weight: 1.00
Name:  G_max_TC258747                               Len: 401   Check: 7372  Weight: 1.00
Name:  G_max_Glyma14g09320_1                        Len: 401   Check: 5388  Weight: 1.00
Name:  G_max_TC266306                               Len: 401   Check: 6097  Weight: 1.00
Name:  M_truncatula_TC129893_CDS                    Len: 401   Check: 1583  Weight: 1.00
Name:  M_truncatula_TC125274                        Len: 401   Check: 7215  Weight: 1.00
Name:  H_annuus_HA04MC01018_66822928_1017           Len: 401   Check: 4926  Weight: 1.00
Name:  H_annuus_TC34117                             Len: 401   Check: 2623  Weight: 1.00
Name:  S_lycopersicum_TC213116                      Len: 401   Check: 8755  Weight: 1.00
Name:  A_thaliana_AT1G46768_1                       Len: 401   Check: 5199  Weight: 1.00
Name:  T_aestivum_TC277269                          Len: 401   Check: 9543  Weight: 1.00
Name:  O_sativa_Os06g0166400                        Len: 401   Check: 6670  Weight: 1.00
Name:  TraitMillCDS                                 Len: 401   Check: 1676  Weight: 1.00
Name:  O_sativa_TC312964_CDS                        Len: 401   Check: 3196  Weight: 1.00
Name:  Z_mays_TA32842_4577999                       Len: 401   Check: 6343  Weight: 1.00
Name:  O_sativa_LOC_Os04g55520_1                    Len: 401   Check: 1133  Weight: 1.00
Name:  T_aestivum_TC314990                          Len: 401   Check: 9816  Weight: 1.00
Name:  T_aestivum_TC277211                          Len: 401   Check: 4350  Weight: 1.00
Name:  A_thaliana_AT4G06746_1                       Len: 401   Check: 8795  Weight: 1.00
```

FIGURE 10

```
                                                 1                                                50
G_max_Glyma17g18580_1                            ~~~~~~~~~~~~~~~~~~~~~~~~~~~~~~~~~~~~~~~~~~~~~~~~~~
G_max_Glyma05g19050_1                            ~~~~~~~~~~~~~~~~~~~~~~~~~~~~~~~~~~~~~~~~~~~~~~~~~~
G_max_Glyma01g39540_1                            ~~~~~~~~~~~~~~~~~~~~~~~~~~~~~~~~~~~~~~~~~~~~~~~~~~
MtAp2ERF_CDS                                     ~~~~~~~~~~~~~~~~~~~~~~~~~~~~~~~~~~~~~~~~~~~~~~~~~~
M_truncatula_TC117996_CDS                        ~~~~~~~~~~~~~~~~~~~~~~~~~~~~~~~~~~~~~~~~~~~~~~~~~~
P_trichocarpa_TC111318                           ~~~~~~~~~~~~~~~~~~~~~~~~~~~~~~~~~~~~~~~~~~~~~~~~~~
P_trichocarpa_TC91546                            ~~~~~~~~~~~~~~~~~~~~~~~~~~~~~~~~~~~~~~~~~~~~~~~~~~
P_trichocarpa_CV260432                           ~~~~~~~~~~~~~~~~~~~~~~~~~~~~~~~~~~~~~~~~~~~~~~~~~~
A_thaliana_AT3G50260_1                           ~~~~~~~~~~~~~~~~~~~~~~~~~~~~~~~~~~~~~~~~~~~~~~~~~~
B_napus_TC67876                                  ~~~~~~~~~~~~~~~~~~~~~~~~~~~~~~~~~~~~~~~~~~~~~~~~~~
B_napus_BN06MC02259_42032738_2254                ~~~~~~~~~~~~~~~~~~~~~~~~~~~~~~~~~~~~~~~~~~~~~~~~~~
B_napus_TC73559                                  ~~~~~~~~~~~~~~~~~~~~~~~~~~~~~~~~~~~~~~~~~~~~~~~~~~
B_napus_TC68928                                  ~~~~~~~~~~~~~~~~~~~~~~~~~~~~~~~~~~~~~~~~~~~~~~~~~~
A_thaliana_AT5G67190_1                           ~~~~~~~~~~~~~~~~~~~~~~~~~~~~~~~~~~~~~~~~~~~~~~~~~~
B_napus_TC79173                                  ~~~~~~~~~~~~~~~~~~~~~~~~~~~~~~~~~~~~~~~~~~~~~~~~~~
B_napus_TC89313                                  ~~~~~~~~~~~~~~~~~~~~~~~~~~~~~~~~~~~~~~~~~~~~~~~~~~
A_thaliana_AT2G23340_1                           ~~~~~~~~~~~~~~~~~~~~~~~~~~~~~~~~~~~~~~~~~~~~~~~~~~
B_napus_TC86323                                  ~~~~~~~~~~~~~~~~~~~~~~~~~~~~~~~~~~~~~~~~~~~~~~~~~~
B_napus_TC72792                                  ~~~~~~~~~~~~~~~~~~~~~~~~~~~~~~~~~~~~~~~~~~~~~~~~~~
A_thaliana_AT4G36900_1_CDS                       ~~~~~~~~~~~~~~~~~~~~~~~~~~~~~~~~~~~~~~~~~~~~~~~~~~
H_annuus_TC30931                                 ~~~~~~~~~~~~~~~~~~~~~~~~~~~~~~~~~~~~~~~~~~~~~~~~~~
H_annuus_TC31134                                 ~~~~~~~~~~~~~~~~~~~~~~~~~~~~~~~~~~~~~~~~~~~~~~~~~~
S_lycopersicum_TC196769_CDS                      ~~~~~~~~~~~~~~~~~~~~~~~~~~~~~~~~~~~~~~~~~~~~~~~~~~
P_trichocarpa_826816                             ~~~~~~~~~~~~~~~~~~~~~~~~~~~~~~~~~~~~~~~~~~~~~~~~~~
P_trichocarpa_644094                             ~~~~~~~~~~~~~~~~~~~~~~~~~~~~~~~~~~~~~~~~~~~~~~~~~~
G_max_TC258747                                   ~~~~~~~~~~~~~~~~~~~~~~~~~~~~~~~~~~~~~~~~~~~~~~~~~~
G_max_Glyma14g09320_1                            ~~~~~~~~~~~~~~~~~~~~~~~~~~~~~~~~~~~~~~~~~~~~~~~~~~
G_max_TC266306                                   ~~~~~~~~~~~~~~~~~~~~~~~~~~~~~~~~~~~~~~~~~~~~~~~~~~
M_truncatula_TC129893_CDS                        ~~~~~~~~~~~~~~~~~~~~~~~~~~~~~~~~~~~~~~~~~~~~~~~~~~
M_truncatula_TC125274                            ~~~~~~~~~~~~~~~~~~~~~~~~~~~~~~~~~~~~~~~~~~~~~~~~~~
H_annuus_HA04MC01018_66822928_1017               ~~~~~~~~~~~~~~~~~~~~~~~~~~~~~~~~~~~~~~~~~~~~~~~~~~
H_annuus_TC34117                                 ~~~~~~~~~~~~~~~~~~~~~~~~~~~~~~~~~~~~~~~~~~~~~~~~~~
S_lycopersicum_TC213116                          ~~~~~~~~~~~~~~~~~~~~~~~~~~~~~~~~~~~~~~~~~~~~~~~~~~
A_thaliana_AT1G46768_1                           ~~~~~~~~~~~~~~~~~~~~~~~~~~~~~~~~~~~~~~~~~~~~~~~~~~
T_aestivum_TC277269                              ~~~~~~~~~~~~~~~~~~~~~~~~~~~~~~~~~~~~~~~~~~~~~~~~~~
O_sativa_Os06g0166400                            ~~~~~~~~~~~~~~~~~~~~~~~~~~~~~~~~~~~~~~~~~~~~~~~~~~
TraitMillCDS                                     MFVRFIVCYLPALIPH.....................LPTAPR...
O_sativa_TC312964_CDS                            MDNHAVAVQQRDTAPRPRARARASVSSIQGGGPGWADHVALPRPPRCHP
Z_mays_TA32842_4577999                           ~~~~~~~~~~~~~~~~~~~~~~~~~~~~~~~~~~~~~~~~~~~~~~~~~~
O_sativa_LOC_Os04g55520_1                        ~~~~~~~~~~~~~~~~~~~~~~~~~~~~~~~~~~~~~~~~~~~~~~~~~~
T_aestivum_TC314990                              ~~~~~~~~~~~~~~~~~~~~~~~~~~~~~~~~~~~~~~~~~~~~~~~~~~
T_aestivum_TC277211                              ~~~~~~~~~~~~~~~~~~~~~~~~~~~~~~~~~~~~~~~~~~~~~~~~~~
A_thaliana_AT4G06746_1                           ~~~~~~~~~~~~~~~~~~~~~~~~~~~~~~~~~~~~~~~~~~~~~~~~~~
```

FIGURE 10 (continued)

```
                                              51                                                100
G_max_Glyma17g18580_1                         ~~~~~~~~~~~~~~~~~~~~~~~~~~~~~~~~~~~~~~~~~~~~~~~~~~
G_max_Glyma05g19050_1                         ~~~~~~~~~~~~~~~~~~~~~~~~~~~~~~~~~~~~~~~~~~~~~~~~~~
G_max_Glyma01g39540_1                         ~~~~~~~~~~~~~~~~~~~~~~~~~~~~~~~~~~~~~~~~~~~~~~~~~~
MtAp2ERF_CDS                                  ~~~~~~~~~~~~~~~~~~~~~~~~~~~~~~~~~~~~~~~~~~~~~~~~~~
M_truncatula_TC117996_CDS                     ~~~~~~~~~~~~~~~~~~~~~~~~~~~~~~~~~~~~~~~~~~~~~~~~~~
P_trichocarpa_TC111318                        ~~~~~~~~~~~~~~~~~~~~~~~~~~~~~~~~~~~~~~~~~~~~~~~~~~
P_trichocarpa_TC91546                         ~~~~~~~~~~~~~~~~~~~~~~~~~~~~~~~~~~~~~~~~~~~~~~~~~~
P_trichocarpa_CV260432                        ~~~~~~~~~~~~~~~~~~~~~~~~~~~~~~~~~~~~~~~~~~~~~~~~~~
A_thaliana_AT3G50260_1                        ~~~~~~~~~~~~~~~~~~~~~~~~~~~~~~~~~~~~~~~~~~~~~~~~~~
B_napus_TC67876                               ~~~~~~~~~~~~~~~~~~~~~~~~~~~~~~~~~~~~~~~~~~~~~~~~~~
B_napus_BN06MC02259_42032738_2254             ~~~~~~~~~~~~~~~~~~~~~~~~~~~~~~~~~~~~~~~~~~~~~~~~~~
B_napus_TC73559                               ~~~~~~~~~~~~~~~~~~~~~~~~~~~~~~~~~~~~~~~~~~~~~~~~~~
B_napus_TC68928                               ~~~~~~~~~~~~~~~~~~~~~~~~~~~~~~~~~~~~~~~~~~~~~~~~~~
A_thaliana_AT5G67190_1                        ~~~~~~~~~~~~~~~~~~~~~~~~~~~~~~~~~~~~~~~~~~~~~~~~~~
B_napus_TC79173                               ~~~~~~~~~~~~~~~~~~~~~~~~~~~~~~~~~~~~~~~~~~~~~~~~~~
B_napus_TC89313                               ~~~~~~~~~~~~~~~~~~~~~~~~~~~~~~~~~~~~~~~~~~~~~~~~~~
A_thaliana_AT2G23340_1                        ~~~~~~~~~~~~~~~~~~~~~~~~~~~~~~~~~~~~~~~~~~~~~~~~~~
B_napus_TC86323                               ~~~~~~~~~~~~~~~~~~~~~~~~~~~~~~~~~~~~~~~~~~~~~~~~~~
B_napus_TC72792                               ~~~~~~~~~~~~~~~~~~~~~~~~~~~~~~~~~~~~~~~~~~~~~~~~~~
A_thaliana_AT4G36900_1_CDS                    ~~~~~~~~~~~~~~~~~~~~~~~~~~~~~~~~~~~~~~~~~~~~~~~~~~
H_annuus_TC30931                              ~~~~~~~~~~~~~~~~~~~~~~~~~~~~~~~~~~~~~~~~~~~~~~~~~~
H_annuus_TC31134                              ~~~~~~~~~~~~~~~~~~~~~~~~~~~~~~~~~~~~~~~~~~~~~~~~~~
S_lycopersicum_TC196769_CDS                   ~~~~~~~~~~~~~~~~~~~~~~~~~~~~~~~~~~~~~~~~~~~~~~~~~~
P_trichocarpa_826816                          ~~~~~~~~~~~~~~~~~~~~~~~~~~~~~~~~~~~~~~~~~~~~~~~~~~
P_trichocarpa_644094                          ~~~~~~~~~~~~~~~~~~~~~~~~~~~~~~~~~~~~~~~~~~~~~~~~~~
G_max_TC258747                                ~~~~~~~~~~~~~~~~~~~~~~~~~~~~~~~~~~~~~~~~~~~~~~~~~~
G_max_Glyma14g09320_1                         ~~~~~~~~~~~~~~~~~~~~~~~~~~~~~~~~~~~~~~~~~~~~~~~~~~
G_max_TC266306                                ~~~~~~~~~~~~~~~~~~~~~~~~~~~~~~~~~~~~~~~~~~~~~~~~~~
M_truncatula_TC129893_CDS                     ~~~~~~~~~~~~~~~~~~~~~~~~~~~~~~~~~~~~~~~~~~~~~~~~~~
M_truncatula_TC125274                         ~~~~~~~~~~~~~~~~~~~~~~~~~~~~~~~~~~~~~~~~~~~~~~~~~~
H_annuus_HA04MC01018_66822928_1017            ~~~~~~~~~~~~~~~~~~~~~~~~~~~~~~~~~~~~~~~~~~~~~~~~~~
H_annuus_TC34117                              ~~~~~~~~~~~~~~~~~~~~~~~~~~~~~~~~~~~~~~~~~~~~~~~~~~
S_lycopersicum_TC213116                       ~~~~~~~~~~~~~~~~~~~~~~~~~~~~~~~~~~~~~~~~~~~~~~~~~~
A_thaliana_AT1G46768_1                        ~~~~~~~~~~~~~~~~~~~~~~~~~~~~~~~~~~~~~~~~~~~~~~~~~~
T_aestivum_TC277269                           ~~~~~~~~~~~~~~~~~~~~~~~~~~~~~~~~~~~~~~~~~~~~~~~~~~
O_sativa_Os06g0166400                         ~~~~~~~~~~~~~~~~~~~~~~~~~~~~~~~~~~~~~~~~~~~~~~~~~~
TraitMillCDS                                  ..........................................THLIPSIYRPH
O_sativa_TC312964_CDS                         RRPPTPCRRPLAFASSSIHPHRAVLPSGAPPHVSAGARDTGGAAGLARPH
Z_mays_TA32842_4577999                        ~~~~~~~~~~~~~~~~~~~~~~~~~~~~~~~~~~~~~~~~~~~~~~~~~~
O_sativa_LOC_Os04g55520_1                     ~~~~~~~~~~~~~~~~~~~~~~~~~~~~~~~~~~~~~~~~~~~~~~~~~~
T_aestivum_TC314990                           ~~~~~~~~~~~~~~~~~~~~~~~~~~~~~~~~~~~~~~~~~~~~~~~~~~
T_aestivum_TC277211                           ~~~~~~~~~~~~~~~~~~~~~~~~~~~~~~~~~~~~~~~~~~~~~~~~~~
A_thaliana_AT4G06746_1                        ~~~~~~~~~~~~~~~~~~~~~~~~~~~~~~~~~~~~~~~~~~~~~~~~~~
```

FIGURE 10 (continued)

```
                                                   101                                    150
G_max_Glyma17g18580_1                              ~~~~~~~~~~~~~~~~~~~~~~~~~~~~~~~~~~~MEGEEGGI...........
G_max_Glyma05g19050_1                              ~~~~~~~~~~~~~~~~~~~~~~~~~~~~~~~~~~~~MEG.EGGS...........
G_max_Glyma01g39540_1                              ~~~~~~~~~~~~~~~~~~~~~~~~~~~~~~~~~~MESEGRREGGE........
MtAp2ERF_CDS                                       ~~~~~~~~~~~~~~~~~~~~~~~~~~~~~~~~~~~~MDGGRGKG...........
M_truncatula_TC117996_CDS                          ~~~~~~~~~~~~~~~~~~~~~~~~~~~~~~~~~~~~MDGGRGKG...........
P_trichocarpa_TC111318                             ~~~~~~~~~~~~~~~~~~~~~~~~~~~~~~~~~~~~~~MESGVD.............
P_trichocarpa_TC91546                              ~~~~~~~~~~~~~~~~~~~~~~~~~~~~~~~~~~~~~~MESGVD.............
P_trichocarpa_CV260432                             ~~~~~~~~~~~~~~~~~~~~~~~~~~~~~~~~~~~~~~MESGVD.............
A_thaliana_AT3G50260_1                             ~~~~~~~~~~~~~~~~~~~~~~~~~~~~~~~~~~~~~~~~MDAG...............
B_napus_TC67876                                    ~~~~~~~~~~~~~~~~~~~~~~~~~~~~~~~~~~MLQHGAAAMEA........
B_napus_BN06MC02259_42032738_2254                  ~~~~~~~~~~~~~~~~~~~~~~~~~~~~~~~~~~~~MD.GGGVA...........
B_napus_TC73559                                    ~~~~~~~~~~~~~~~~~~~~~~~~~~~~~~~~~~~~MD.GGGAA...........
B_napus_TC68928                                    ~~~~~~~~~~~~~~~~~~~~~~~~~~~~~~~~~~~MEGGGGVA...........
A_thaliana_AT5G67190_1                             ~~~~~~~~~~~~~~~~~~~~~~~~~~~~~~~~~~~~~ME.GGGVA...........
B_napus_TC79173                                    ~~~~~~~~~~~~~~~~~~~~~~~~~~~~~~~~~~~~~METGAKV............
B_napus_TC89313                                    ~~~~~~~~~~~~~~~~~~~~~~~~~~~~~~~~~~METGAKVTAATGAV.....
A_thaliana_AT2G23340_1                             ~~~~~~~~~~~~~~~~~~~~~~~~~~~~~~~~~~~~METEAAVTATV........
B_napus_TC86323                                    ~~~~~~~~~~~~~~~~~~~~~~~~~~~~~~~~~~~~METVMEVAAAVP.......
B_napus_TC72792                                    ~~~~~~~~~~~~~~~~~~~~~~~~~~~~~~~~~~~~METARDVAAAVP.......
A_thaliana_AT4G36900_1_CDS                         ~~~~~~~~~~~~~~~~~~~~~~~~~~~~~~~~~~METATEVATVVST......
H_annuus_TC30931                                   ~~~~~~~~~~~~~~~~~~~~~~~~~~~~~~~~~~~~~~~~~ME................
H_annuus_TC31134                                   ~~~~~~~~~~~~~~~~~~~~~~~~~~~~~~~~~~~~~~MGAQHH.............
S_lycopersicum_TC196769_CDS                        ~~~~~~~~~~~~~~~~~~~~~~~~~~~~~~~~~~~~~~~~~M.................
P_trichocarpa_826816                               ~~~~~~~~~~~~~~~~~~~~~~~~~~~~~~~~~MEGGCCTSSTSTPSST...
P_trichocarpa_644094                               ~~~~~~~~~~~~~~~~~~~~~~~~~~~~~~~~~MEGECYTSPSASSSTP...
G_max_TC258747                                     ~~~~~~~~~~~~~~~~~~~~~~~~~~~~~~~~~MEEAGLGDCCSSNTTIT..
G_max_Glyma14g09320_1                              ~~~~~~~~~~~~~~~~~~~~~~~~~~~~~~~~~MEDR..DHCCSNNSTMITT
G_max_TC266306                                     ~~~~~~~~~~~~~~~~~~~~~~~~~~~~~~~~~MEER..DHRCSNNSTMITT
M_truncatula_TC129893_CDS                          ~~~~~~~~~~~~~~~~~~~~~~~~~~~~~~MEEEDREYCCSMNSRT...
M_truncatula_TC125274                              ~~~~~~~~~~~~~~~~~~~~~~MVQQSESTRRIMEEE..RDCCSTIIRN...
H_annuus_HA04MC01018_66822928_1017                 ~~~~~~~~~~~~~~~~~~~~~~~~~~~~~~~~~~~~MEATITGGGD.........
H_annuus_TC34117                                   ~~~~~~~~~~~~~~~~~~~~~~~~~~~~~~~~~~MEARKPFSGSVSGD.....
S_lycopersicum_TC213116                            ~~~~~~~~~~~~~~~~~~~~~~~~~~~~~~~~~~~~MEIGGGGQSGVA.......
A_thaliana_AT1G46768_1                             ~~~~~~~~~~~~~~~~~~~~~~~~~~~~~~~~~~~~MEREQEESTMRKRR.....
T_aestivum_TC277269                                ~~~~~~~~~~~~~~~~~~~~~~~~~~~~~~~MEREATVAFYPPAPAPQQQ
O_sativa_Os06g0166400                              ~~~~~~~~~~~~~~~~~~~~~~~~~~~~~~~MDRREATVFLPPPPPPQPT
TraitMillCDS                                       HSFPQEKKPKPRHAGVASPRLALAPLRNSARMDRREATVFLPPPPPPQPT
O_sativa_TC312964_CDS                              HSFPQEKKPKPRHAGVASPRLALAPLRNSARMDRREATVFLPPPPPPQPT
Z_mays_TA32842_4577999                             ~~~~~~~~~~~~~~~~~~~~~~~~~~~~~~~~~~~MEAEQAAMASAAAPQLGS.
O_sativa_LOC_Os04g55520_1                          ~~~~MQGEYHRSSSEDSAASAAAAAAAAAAAMAPLAAAAAAVAAKEEQA.
T_aestivum_TC314990                                ~~~~MQQGEYRSSSSSEGSAGS..ASAAAAAMAPLAAAVAAVAAKEEHNV
T_aestivum_TC277211                                ~~~~MQQGEYRSSSSSEGSAGSAAAAAAAAAMAPLAAAAAAVAAKEEHNV
A_thaliana_AT4G06746_1                             ~~~~~~~~~~~~~~~~~~~~~~~~~~~~~~~~~~~~~MVIQYKRKQEFPMVKE...
```

FIGURE 10 (continued)

```
                                                        151                                           200
G_max_Glyma17g18580_1                          ...........ATKKRGKEG..ETETTRYKGIRMRKWGKWVAEIREPNKR
G_max_Glyma05g19050_1                          ...........ATRKRGKDG.ETETTTRYKGIRMRKWGKWVAEIREPNKR
G_max_Glyma01g39540_1                          ...........RETTAATRK.VEGAERRYKGIRMRKWGKWVAEIREPNKR
MtAp2ERF_CDS                                   ...........ERKRNGGGV.GVDGERRYKGIRMRKWGKWVAEIREPNKR
M_truncatula_TC117996_CDS                      ...........ERKRNGGGV.GVDGERRYKGIRMRKWGKWVAEIREPNKR
P_trichocarpa_TC111318                         ...........KDMATRKRG.GIESERQYKGIRMRKWGKWVAEIREPNKR
P_trichocarpa_TC91546                          ...........KDMATRKRG.GIESERQYKGIRMRKWGKWVAEIREPNKR
P_trichocarpa_CV260432                         ...........KEMATRKRG.GMGSERQYKGIRMRKWGKWVAEIREPNKR
A_thaliana_AT3G50260_1                         ...........VAVKADVAV.KMKRERPFKGIRMRKWGKWVAEIREPNKR
B_napus_TC67876                                ...........GVAAADMAG.VRKRERPYKGIRMRKWGKWVAEIREPNKR
B_napus_BN06MC02259_42032738_2254              ...........DVAVA..MT.TRKRERPYKGIRMRKWGKWVAEIREPNKR
B_napus_TC73559                                ...........DVAVA..VT.TRKRERPYKGIRMRKWGKWVAEIREPNKR
B_napus_TC68928                                ...........NVAVSGTTT.TRKRERPYKGIRMRKWGKWVAEIREPNKR
A_thaliana_AT5G67190_1                         ...........DVAVP...G.TRKRDRPYKGIRMRKWGKWVAEIREPNKR
B_napus_TC79173                                ...........TAATMGIGT.RKRDLKPYKGIRMRKWGKWVAEIREPNKR
B_napus_TC89313                                ...........TAATMGIGT.RKRDLKPYKGIRMRKWGKWVAEIREPNKR
A_thaliana_AT2G23340_1                         ...........TAATMGIGT.RKRDLKPYKGIRMRKWGKWVAEIREPNKR
B_napus_TC86323                                ...........TSTVAAPAA.TRKREKPYKGIRMRKWGKWVAEIREPNKR
B_napus_TC72792                                ...........ALTVAAAAA.TRKREKPYKGIRMRKWGKWVAEIREPNKR
A_thaliana_AT4G36900_1_CDS                     ...........PAVTVAAVA.TRKRDKPYKGIRMRKWGKWVAEIREPNKR
H_annuus_TC30931                               ............PAATTAA.TSSNSKPYRGIRMRKWGKWVAEIREPNKR
H_annuus_TC31134                               ...........HTTQNSSTR.KPQNTKPYRGIRMRKWGKWVAEIREPNKR
S_lycopersicum_TC196769_CDS                    ...........MEGEKRKQR.QHQQDKPYRGIRMRKWGKWVAEIREPNKR
P_trichocarpa_826816                           ........STATTEKRKHSR.QQNQEKPYRGIRMRKWGKWVAEIREPNKR
P_trichocarpa_644094                           .......TISSIGKRKHGR.QQNQEKPYRGIRMRKWGKWVAEIREPNKR
G_max_TC258747                                 ...........RKSEKRKQQ.HQQQEKPYRGIRMRKWGKWVAEIREPNKR
G_max_Glyma14g09320_1                          TKKRTGRRSPTSDKLKNQHR.EKQSMKPYRGIRMRKWGKWVAEIREPNKR
G_max_TC266306                                 TKKKTSRRSPTSDKLKNQHPCEKQAMKPYRGIRMRKWGKWVAEIREPNKR
M_truncatula_TC129893_CDS                      TNSPIAIDHKNNNNNKGMKK.EKKAMKPYRGIRMRKWGKWVAEIREPNKR
M_truncatula_TC125274                          ........IESNNKPQEKHN.KQQLEKPYRGIRKRKWGKWVAEIREPNKR
H_annuus_HA04MC01018_66822928_1017             ...........GPCNRPPEK.RKSDQRPYKGIRMRKWGKWVAEIREPNKR
H_annuus_TC34117                               ...........LNYSPAAGK.RKSDQRPYKGIRMRKWGKWVAEIREPNKR
S_lycopersicum_TC213116                        ...........ANSGVCCGG.KRKNEKPYKGIRMRKWGKWVAETREPNKR
A_thaliana_AT1G46768_1                         ...........QPPQEEVPN.HVATRKPYRGIRRRKWGKWVAEIREPNKR
T_aestivum_TC277269                            RPTAAQPLSARVPAGGVHAG.RGGGGRQYRGVRMRKWGKWVAEIREPNKR
O_sativa_Cs06g0166400                          QPQQQP..AAAAVRAPVGGR.GGGGGRQYRGVRMRKWGKWVAEIREPNKR
TraitMillCDS                                   QPQQQP..AAAAVRAPVGGR.GGGGGRQYRGVRMRKWGKWVAEIREPNKR
O_sativa_TC312964_CDS                          QPQQQP..AAAAVRAPVGGR.GGGGGRQYRGVRMRKWGKWVAEIREPNKR
Z_mays_TA32842_4577999                         ...........AHQHQHQHQ.QMQPRRQYRGVRMRKWGKWVAEIREPHKR
O_sativa_LOC_Os04g55520_1                      ...........AAAAVLPLQ.QQQPRRQYRGVRMRKWGKWVAEIREPHKR
T_aestivum_TC314990                            TVAVAPPM...PMAMAMPLQ.QQQPRKQYRGVRMRKWGKWVAEIREPHKR
T_aestivum_TC277211                            TVAVAPPM...PMAMAMPLQ.QQQPRKQYRGVRMRKWGKWVAEIREPHKR
A_thaliana_AT4G06746_1                         ........GMVMTEKPKRNL.ISSNEKRYKGIRMRKWGKWVAEIREPNKR
```

FIGURE 10 (continued)

```
                                                  201                                               250
G_max_Glyma17g18580_1                             SRIWLGSYSTPVAAARAYDTAVFHLRGPSARLNFPELVAAEGPA......
G_max_Glyma05g19050_1                             SRIWLGSYSTPVAAARAYDTAVFYLRGPSARLNFPELLAAEGPAA.....
G_max_Glyma01g39540_1                             SRIWLGSYSTPVAAARAYDTAVFYLRGPSARLNFPELLVREGPAALV...
MtAp2ERF_CDS                                      SRIWLGSYSTPIAAARAYDTAVFYLRGPSARLNFPELLNGENNAVV....
M_truncatula_TC117996_CDS                         SRIWLGSYSTPIAAARAYDTAVFYLRGPSARLNFPELLNGENNAVV....
P_trichocarpa_TC111318                            SRIWLGSYSTPVAAARAYDTAVFYLRGPSARLNFPEFLAGEGFGGGG...
P_trichocarpa_TC91546                             SRIWLGSYSTPVAAARAYDTAVFYLRGPSARLNFPEVLAAEGFGGGG...
P_trichocarpa_CV260432                            SRIWLGSYSTPVAAARAYDTAVFYLRGPSARLNFPEFLAGENFSCGG...
A_thaliana_AT3G50260_1                            SRLWLGSYSTPEAAARAYDTAVFYLRGPTATLNFPELLPCT.........
B_napus_TC67876                                   SRLWLGSYSTPEAAARAYDTAVFYLRGPTATLNFPELIPSIEKS......
B_napus_BN06MC02259_42032738_2254                 TRLWLGSYSTPEAAARAYDTAVFYLRGPTARLNFPEFLTGEKF.......
B_napus_TC73559                                   TRLWLGSYSTPEAAARAYDTAVFYLRGPTARLNFPEFLTGEKF.......
B_napus_TC68928                                   SRLWLGSYSTPEAAARAYDTAVFYLRGPTARLNFPELLTGEKF.......
A_thaliana_AT5G67190_1                            SRLWLGSYSTPEAAARAYDTAVFYLRGPTARLNFPELLPGEKF.......
B_napus_TC79173                                   SRIWLGSYSTPEAAARAYDTAVFYLRGPSARLNFPELLAGLTSSG.....
B_napus_TC89313                                   SRIWLGSYSTPEAAARAYDTAVFYLRGPSARLNFPELLAGLTGSG.....
A_thaliana_AT2G23340_1                            SRIWLGSYATPEAAARAYDTAVFYLRGPSARLNFPELLAGLTVSNGGG..
B_napus_TC86323                                   SRIWLGSYSTPEAAARAYDTAVFYLRGPSARLNFPELLAGVTVAGGN...
B_napus_TC72792                                   SRIWLGSYSTPEAAARAYDTAVYYLRGPSARLNFPELLAGVTVEGGN...
A_thaliana_AT4G36900_1_CDS                        SRIWLGSYSTPEAAARAYDTAVFYLRGPSARLNFPELLAGVTVTGGGGGG
H_annuus_TC30931                                  SRIWLGSYSSPIAAARAYDTAVFYLRGPSARLNFPDSIGEYGGCSAG...
H_annuus_TC31134                                  SRIWLGSYSSPVAAARAYDTAVFYLRGPSARLNFPDKIGDDGC.......
S_lycopersicum_TC196769_CDS                       SRIWLGSYSSPVAAARAYDTAVFYLRGPSARLNFPECIVDDH........
P_trichocarpa_826816                              SRIWLGSYSTPIAAARAYDTAVFYLRGPSARLNFPDLIYQED........
P_trichocarpa_644094                              SRIWLGSYSTPIAAARAYDTAVFYLRGPSVRLNFPDLIHQED........
G_max_TC258747                                    SRIWLGSYATPVAAARAYDTAVFHLRGPSARLNFPELLSQDDDVSTQ...
G_max_Glyma14g09320_1                             SRIWLGSYTTPVAAARAYDTAVFYLRGPTARLNFPELLFQDDDQEGSDSV
G_max_TC266306                                    SRIWLGSYTTPMAAARAYDTAVFYLRGPTARLNFPELLFQDDQEEGNDSV
M_truncatula_TC129893_CDS                         SRIWLGSYITPIAAARAYDTAVFYLRGPSANLNFPELLFKDQQEDEENLQ
M_truncatula_TC125274                             SRIWLGSYITPVAAARAYDTAVFYLRGPTARLNFPELLLEDDEENKDGSI
H_annuus_HA04MC01018_66822928_1017                SRIWLGSYSTPVAAARAYDTAVYYLRGPTARLNFPELLGSDV........
H_annuus_TC34117                                  SRIWLGSYSTPLAAARAYDTAVYYLRGPSARLNFPELMASDG........
S_lycopersicum_TC213116                           SRIWLGSYSTPVAAARAYDTAVYYLICPSARLNFPELLVGDG........
A_thaliana_AT1G46768_1                            SRLWLGSYTTDIAAARAYDVAVFYLRGPSARLNFPDLLLQEEDHLSAA..
T_aestivum_TC277269                               SRIWLGSYATAVAAARAYDTAVFYLRGRSARLNFPDQLLDGTAPAA....
O_sativa_Os06g0166400                             SRIWLGSYSTAVAAARAYDTAVFYLRGRSARLNFPDQLDGAGGGGAGAGG
TraitMillCDS                                      SRIWLGSYSTAVAAARAYDTAVFYLRGRSARLNFPDQLDGAGGGGAGAGG
O_sativa_TC312964_CDS                             SRIWLGSYSTAVAAARAYDTAVFYLRGRSARLNFPDQLDGAGGGGAGAGG
Z_mays_TA32842_4577999                            TRIWLGSYATAVAAARAYDTAVFYLRGRSARLNFPDEIPSLAPSEGEGDG
O_sativa_LOC_Os04g55520_1                         TRIWLGSYATPVAAARAYDTAVFYLRGRSARLNFPEEISSLASLSEGGGA
T_aestivum_TC314990                               TRIWLGSYATPVAAARAYDTAVFYLRGRSARLNFPDEISALALSSPEAAA
T_aestivum_TC277211                               TRIWLGSYATPVAAARAYDTAVFYLRGRSARLNFPDEISALALSSPEAAE
A_thaliana_AT4G06746_1                            SRIWLGSYKTAVAAARAYDTAVFYLRGPSARLNFPEEVFKDGNGGEG...
```

FIGURE 10 (continued)

```
                                                251                                                 300
G_max_Glyma17g18580_1                           ...............ADMSAASIRKKATEVGARVDALHRQH........P
G_max_Glyma05g19050_1                           ..............SDAVMSAASIRKKATEVGARVDALHRQD........P
G_max_Glyma01g39540_1                           .............AGCDMSAASIRKKATEVGARVDALQATL........H
MtAp2ERF_CDS                                    ............GGGDMSAATIRKKATEVGARVDALQADV........N
M_truncatula_TC117996_CDS                       ............GGGDMSAATIRKKATEVGARVDALQADV........N
P_trichocarpa_TC111318                          ............SCGDMSAASIRKKRATEVGAHVDAIETAL........N
P_trichocarpa_TC91546                           ............SCGDMSAASIRKRATEVGAHVDAIETAL........N
P_trichocarpa_CV260432                          ............SYGDMSAASIRKRATEVGARVDAFETAL........N
A_thaliana_AT3G50260_1                          ............SAEDMSAATIRKKATEVGAQVDAIGATV........V
B_napus_TC67876                                 ............SVEDMSAAAIRRKATEVGAEVDAYGMAV........M
B_napus_BN06MC02259_42032738_2254               ............SEEDMSGDTIRRKKATEVGAQVDALGTAV........L
B_napus_TC73559                                 ............SEEDMSGDTIRRKKATEVGAQVDALGTAV........L
B_napus_TC68928                                 ............TEEDMSAATIRKKATEVGAQVDALGSAV........L
A_thaliana_AT5G67190_1                          ............SDEDMSAATIRKKATEVGAQVDALGTAV........Q
B_napus_TC79173                                 ............GGGDMSAADIRRKAAEVGAQVDALGATV........V
B_napus_TC89313                                 ............GGGDMSAAYIRRKAAEVGAQVDALGATV........V
A_thaliana_AT2G23340_1                          ............RGGDLSAAYIRRKAAEVGAQVDALGATV........V
B_napus_TC86323                                 ............GGGDMSAAYIRRKAAEVGAQVDALEAAG.....GNRR
B_napus_TC72792                                 ............GGGDMSAAYIRRKAAEVGAQVDALEAAG.....GNRH
A_thaliana_AT4G36900_1_CDS                      VN..........GGGDMSAAYIRRKAAEVGAQVDALEAAG...AGGNRH
H_annuus_TC30931                                ............GLHDLSAAAIRKKATEVGAKVDALENQN........G
H_annuus_TC31134                                ............GLCDLSAADIRKKATEVGAKVDALQNEG........A
S_lycopersicum_TC196769_CDS                     ............EIHDLSAASIKKKATEVGARVDALQTAI........H
P_trichocarpa_826816                            ............ELRDVSAASIRKKATEVGAKVDALQTAV........H
P_trichocarpa_644094                            ............ELCDVSAASIRKKATEVGAKVDALQTAL........H
G_max_TC258747                                  ............QQGNMSADSIRKKATQVGARVDALQTAL........Q
G_max_Glyma14g09320_1                           QHG.........AAGNMSADSIRRKATQVGARVDALQTAL........H
G_max_TC266306                                  QHGA........AAGNMSADSIRRKATQVGARVDALQTAL........H
M_truncatula_TC129893_CDS                       ............QHGNMSADSIRKKAAQVGARVDAIETNS........L
M_truncatula_TC125274                           ............QQGNMSADLIRKKATKVGARVDALQAAL........Q
H_annuus_HA04MC01018_66822928_1017              ............AFGELSAASIRKKAIEVGARVDAETSCT........S
H_annuus_TC34117                                ............GLDELSTASIRKKAIEVGARVDAETCCT........L
S_lycopersicum_TC213116                         ............GLNDLSAASIRKKAIEVGAQVDAVQNSL........A
A_thaliana_AT1G46768_1                          ............TTADMPAALIREKAAEVGARVDALLASA........A
T_aestivum_TC277269                             ............APGDLTAAAIRKKAAEVGARVDALHSGG......IG
O_sativa_Os06g0166400                           AE..........DHRELTAAVIRKKAAEVGARVDAQHSVV........G
TraitMillCDS                                    AE..........DHRELTAAVIRKKAAEVGARVDAQHSVV........G
O_sativa_TC312964_CDS                           AE..........DHRELTAAVIRKKAAEVGARVDAQHSVV........G
Z_mays_TA32842_4577999                          DGGEPARDPADGGGGGTLSAASIRKKAIEVGSRVDALQTGM...MVPPPH
O_sativa_LOC_Os04g55520_1                       SE.......PREPDGGTLSAASIRKKAIEVGSRVDALQTGM..MVAPTTH
T_aestivum_TC314990                             EAGGE....EPGDGGGALSAASIRKKAIEVGSRVDALQTGMTTMVAAPAH
T_aestivum_TC277211                             AGCCE....EPGGGGGALSAASIRKKAIEVGSRVDALQTGMTTMVAAPAH
A_thaliana_AT4G06746_1                          ............LGGDMSPTLIRKKAAEVGARVDAELR...........
```

FIGURE 10 (continued)

```
                                                 301                    350
G_max_Glyma17g18580_1                            HA................................................
G_max_Glyma05g19050_1                            HA................................................
G_max_Glyma01g39540_1                            HHYV....PPRQLLSGG.................................
MtAp2ERF_CDS                                     HHSH....SHSHNHNHH..........HLQHNRNQH.........HRVM
M_truncatula_TC117996_CDS                        HHSH....SHSHNHNHH..........HLQHNRNQH.........HRVM
P_trichocarpa_TC111318                           HHHH....HLHHDDRQR.............................NSNN
P_trichocarpa_TC91546                            HHHHHHHHHLHHDDRQR.............................NSNN
P_trichocarpa_CV260432                           HHHH.....RHHDDRQR.............................NSSN
A_thaliana_AT3G50260_1                           QNNK...RRRVFSQKRD.................................
B_napus_TC67876                                  NSKR....RRVFGQKCD.................................
B_napus_BN06MC02259_42032738_2254                NSRH.....RVFGQNGE..........SDDSDKNFHRSYRNGESE....
B_napus_TC73559                                  NNRH.....RVFGQNGE..........SDDSKNFHRNYRNGESE....
B_napus_TC68928                                  DNRH.....RVFGQDQE..........SCDDSKNFRRNYQNGDGEEHED
A_thaliana_AT5G67190_1                           NNRH.....RVFGQNRD..........SDVDNKNFHRNYQNGEREE.EE
B_napus_TC79173                                  VKPG.....ESLGGYED.................................
B_napus_TC89313                                  VKPG.....ESLGGYED.................................
A_thaliana_AT2G23340_1                           VNTG....GENRGDYEK.................................
B_napus_TC86323                                  HHHH...QQYQRGNHDY.............VDDDHSVNHSDYRLNDGQH
B_napus_TC72792                                  HHHHHQQQQQQRGSHEY.............VDDDHSLNHSDYRLNDGHN
A_thaliana_AT4G36900_1_CDS                       HHHH....QHQRGNHDY.............VD.....NHSDYRINDDLM
H_annuus_TC30931                                 ASRQ........REPVGV................................
H_annuus_TC31134                                 GACR........KICET.................................
S_lycopersicum_TC196769_CDS                      NSTV....NSVESNCNS.................................
P_trichocarpa_826816                             ASPE....DN........................................
P_trichocarpa_644094                             ASPG....DN........................................
G_max_TC258747                                   QSSS....TH........................................
G_max_Glyma14g09320_1                            HHA...............................................
G_max_TC266306                                   HHA...............................................
M_truncatula_TC129893_CDS                        INHH..HHHHVSSNNHV.................................
M_truncatula_TC125274                            ASS...............................................
H_annuus_HA04MC01018_66822928_1017               LLRS....GTRVPGSG..................................
H_annuus_TC34117                                 VHKS....GTFEHHHNC.................................
S_lycopersicum_TC213116                          THHN....HTEEKVHSE.................................
A_thaliana_AT1G46768_1                           PSMA..............................................
T_aestivum_TC277269                              VGMG....APAAPPS...................................
O_sativa_Os06g0166400                            AAAP....VPLQPPQPP.................................
TraitMil1CDS                                     AAAP....VPLQPPQPP.................................
O_sativa_TC312964_CDS                            AAAP....VPLQPPQPP.................................
Z_mays_TA32842_4577999                           HRER....QKHHHHHHHHLPQLRMHAAAAEAAAAEHR...........Q
O_sativa_LOC_Os04g55520_1                        HRER....QKHHHHHHHHPH.......LQPHGEEQH............H
T_aestivum_TC314990                              HRER....QRLHQHHHH..........AEPHAEELH.............
T_aestivum_TC277211                              HRER....QRLHHHHHH..........AEPHGEELH.............
A_thaliana_AT4G06746_1                           ..................................................
```

FIGURE 10 (continued)

```
                                                   351                                               400
G_max_Glyma17g18580_1                              ........LPAGE...FADR.VDLNKMPEPENSDCDYWDRD~~~~~~~~~~
G_max_Glyma05g19050_1                              ........PPAGE...FADR.VDLNKIPEPENSDCDYWGGD~~~~~~~~~~
G_max_Glyma01g39540_1                              ........GGGSGD...FPVRVVDLNKMPEPESSDCEWDVN~~~~~~~~~~
MtAp2ERF_CDS                                       PVPELLEGDGSGD...FAER.VDLNKIPEPESSDEWDVN~~~~~~~~~~~~
M_truncatula_TC117996_CDS                          PVPELLEGDGSGD...FAER.VDLNKIPEPESSDEWDVN~~~~~~~~~~~~
P_trichocarpa_TC111318                             SSSSNDNNETVVDSKELKPRPVDLNKVPDPQ...GFRWR~~~~~~~~~~~~
P_trichocarpa_TC91546                              SSSSNDNNETVVDSRELKPRPVDLNKVPDPEDSDGDEWKRS~~~~~~~~~~
P_trichocarpa_CV260432                             STSSNDNNETVVDSRELKSRPVDLNKVPDPEDSDGDEWERSLATGGNPMG
A_thaliana_AT3G50260_1                             .........FGGG...LLEL.VDLNKLPDPENLDDDLVGK~~~~~~~~~~~
B_napus_TC67876                                    .........YVGG...LLER.VDLNKLPYPENQDNDVVGK~~~~~~~~~~~
B_napus_BN06MC02259_42032738_2254                  ..EDDKSLKSGGW...LLER.VDLNKVPDPENSDDDWESK~~~~~~~~~~~
B_napus_TC73559                                    ..EDDKSLKSGGW...LLER.VDLNKVPDPENSDDDWESK~~~~~~~~~~~
B_napus_TC68928                                    DDEDEKRLKSGGW...LLER.VDLNKLPDPESSDEDWESK~~~~~~~~~~~
A_thaliana_AT5G67190_1                             EDEDDKRLRSGGR...LLDR.VDLNKLPDPESSDEEWESKH~~~~~~~~~~
B_napus_TC79173                                    .KDNCTGVKSGNG...SLER.VDLNKLPDPENSEDDDQWVKRR~~~~~~~~
B_napus_TC89313                                    .KDNCNGVKSGNG...SLER.VDLNKLPDPENSDDDDQWVKRR~~~~~~~~
A_thaliana_AT2G23340_1                             .IENCR..KSGNG...SLER.VDLNKLPDPENSDGDDDECVKRR~~~~~~~
B_napus_TC86323                                    ECSSKD..KRCNG...SWEA.VDLNKLPDPETSEDD~~~~~~~~~~~~~~~
B_napus_TC72792                                    ECSSKEEFKRCNG...SWEA.VDLNKLPDPETSDDD~~~~~~~~~~~~~~~
A_thaliana_AT4G36900_1_CDS                         ECSSKEGFKRCNG...SLER.VDLNKLPDPETSDDD~~~~~~~~~~~~~~~
H_annuus_TC30931                                   ........QRCSGR...VCLN.TDLNEYPTPETSDEN~~~~~~~~~~~~~~
H_annuus_TC31134                                   ........ESYSGR...VCLN.TDLNEYPSPESSCDEDN~~~~~~~~~~~~
S_lycopersicum_TC196769_CDS                        ........NSKSTR...MMMK.PDLNEYPSPESCDEDN~~~~~~~~~~~~~
P_trichocarpa_826816                               ............SRVL.LSEK.PDLNKFP..ENSDEE~~~~~~~~~~~~~~
P_trichocarpa_644094                               ........SPANRLL.LSEK.PDLNEYP..ENCDEE~~~~~~~~~~~~~~~
G_max_TC258747                                     ........SISSSHVSSYEK.PDLNEYPKPED~~~~~~~~~~~~~~~~~~
G_max_Glyma14g09320_1                              ........PSTNS...LNLK.PDLNEFPKLEELQD~~~~~~~~~~~~~~~~
G_max_TC266306                                     ........SSTNS.....LK.PDLNEFPKLESLQD~~~~~~~~~~~~~~~~
M_truncatula_TC129893_CDS                          ........HSNST...SSLK.PDLNEFPKPEDC~~~~~~~~~~~~~~~~~~
M_truncatula_TC125274                              ........RSDSDQFNADVK.PDLNKFPEPEDY~~~~~~~~~~~~~~~~~~
H_annuus_HA04MC01018_66822928_1017                 LKACW...FQEK.PDLNMKPEPEENDGDYW~~~~~~~~~~
H_annuus_TC34117                                   ..PSSSELKKACW...FQEK.PDLNKKPESEDPDGDC~~~~~~~~~~~~~~
S_lycopersicum_TC213116                            ..TASPSELKPCW...FQEK.PDLNLKPEPEDPEVDYW~~~~~~~~~~~~~
A_thaliana_AT1G46768_1                             .........HSTP...PVIK.PDLNQIPESGDI~~~~~~~~~~~~~~~~~~
T_aestivum_TC277269                                ........PSQRR...RAKN.PDLNREPTPDTDDDE~~~~~~~~~~~~~~~
O_sativa_Os06g0166400                              ........PPQRR...RTKN.PDLNREPTPDTSDDE~~~~~~~~~~~~~~~
TraitMillCDS                                       ........PPQRR...RTKN.PDLNREPTPDTSDDE~~~~~~~~~~~~~~~
O_sativa_TC312964_CDS                              ........PPQRR...RTKN.PDLNREPTPDTSDDE~~~~~~~~~~~~~~~
Z_mays_TA32842_4577999                             EVKQSPQRPAWSG...RVKN.PDLNRAPSPESSDAE~~~~~~~~~~~~~~~
O_sativa_LOC_Os04g55520_1                          HHEQKHQRTAWSG...RAKN.PDLNQAPSPENSDAE~~~~~~~~~~~~~~~
T_aestivum_TC314990                                .RHVKQQRTAWNG...RAKN.PDLNQAPSPDTSDAE~~~~~~~~~~~~~~~
T_aestivum_TC277211                                .RHVKQQRTAWNG...RAKN.PDLNQAPSPDTSDAEAE~~~~~~~~~~~~~
A_thaliana_AT4G06746_1                             .........LENR...MVEN.LDMNKLPEAYGL~~~~~~~~~~~~~~~~~~
```

FIGURE 10 (continued)

```
                                                401 401
G_max_Glyma17g18580_1                            ~
G_max_Glyma05g19050_1                            ~
G_max_Glyma01g39540_1                            ~
MtAp2ERF_CDS                                     ~
M_truncatula_TC117996_CDS                        ~
P_trichocarpa_TC111318                           ~
P_trichocarpa_TC91546                            ~
P_trichocarpa_CV260432                           C
A_thaliana_AT3G50260_1                           ~
B_napus_TC67876                                  ~
B_napus_BN06MC02259_42032738_2254                ~
B_napus_TC73559                                  ~
B_napus_TC68928                                  ~
A_thaliana_AT5G67190_1                           ~
B_napus_TC79173                                  ~
B_napus_TC89313                                  ~
A_thaliana_AT2G23340_1                           ~
B_napus_TC86323                                  ~
B_napus_TC72792                                  ~
A_thaliana_AT4G36900_1_CDS                       ~
H_annuus_TC30931                                 ~
H_annuus_TC31134                                 ~
S_lycopersicum_TC196769_CDS                      ~
P_trichocarpa_826816                             ~
P_trichocarpa_644094                             ~
G_max_TC258747                                   ~
G_max_Glyma14g09320_1                            ~
G_max_TC266306                                   ~
M_truncatula_TC129893_CDS                        ~
M_truncatula_TC125274                            ~
H_annuus_HA04MC01018_66822928_1017               ~
H_annuus_TC34117                                 ~
S_lycopersicum_TC213116                          ~
A_thaliana_AT1G46768_1                           ~
T_aestivum_TC277269                              ~
O_sativa_Os06g0166400                            ~
TraitMil1CDS                                     ~
O_sativa_TC312964_CDS                            ~
Z_mays_TA32842_4577999                           ~
O_sativa_LOC_Os04g55520_1                        ~
T_aestivum_TC314990                              ~
T_aestivum_TC277211                              ~
A_thaliana_AT4G06746_1                           ~
```

FIGURE 10 (continued)

where gene* =  A.thaliana_DNTPS1-TPPB  or
S.cerevisiae_TPS1/TPS2_fusion  or
S.cerevisiae_Chl.TPS1/TPS2_fusion

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2010/065462, filed Oct. 14, 2010, which claims benefit of U.S. Provisional Application 61/253,855, filed Oct. 22, 2009, U.S. Provisional Application 61/253,856, filed Oct. 22, 2009, U.S. Provisional Application 61/254,238, filed Oct. 23, 2009, U.S. Provisional Application 61/254,222, filed Oct. 23, 2009, European application 09173802.1, filed Oct. 22, 2009, European application 09173796.5, filed Oct. 22, 2009, European application 09173919.3, filed Oct. 23, 2009, and European application 09173961.5, filed Oct. 23, 2009.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_074040_0084. The size of the text file is 1,456 KB, and the text file was created on Nov. 10, 2014.

The present invention relates generally to the field of molecular biology and concerns a method for enhancing yield-related traits in plants by modulating expression in a plant of a nucleic acid encoding a CLC-like (Chloride Channel-like) polypeptide. The present invention also concerns plants having modulated expression of a nucleic acid encoding a CLC-like polypeptide, which plants have enhanced yield-related traits relative to corresponding wild type plants or other control plants. The invention also provides constructs useful in the methods of the invention.

The present invention relates generally to the field of molecular biology and concerns a method for enhancing yield-related traits in plants by modulating expression in a plant of a nucleic acid encoding an OsBURP-like (BURP-domain containing protein) polypeptide. The present invention also concerns plants having modulated expression of a nucleic acid encoding an OsBURP-like polypeptide, which plants have enhanced yield-related traits relative to corresponding wild type plants or other control plants. The invention also provides constructs useful in the methods of the invention.

The present invention relates generally to the field of molecular biology and concerns a method for enhancing yield-related traits in plants by modulating expression in a plant of a nucleic acid encoding an AP2/ERF polypeptide. The present invention also concerns plants having modulated expression of a nucleic acid encoding an AP2/ERF polypeptide, which plants have enhanced yield-related traits relative to corresponding wild type plants or other control plants. The invention also provides constructs useful in the methods of the invention.

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding a protein fusion comprising a TPS (trehalose-6-phosphate synthase) and a TPP (trehalose-6-phosphate phosphatise) polypeptide or modulating one or more nucleic acid encoding a TPS and a TPP enzyme, whether comprised in the same or in separate molecules. The present invention also concerns plants having modulated expression of a nucleic acid encoding a TPP polypeptide, which plants have enhanced yield-related traits relative to control plants particularly when cultivated under nitrogen-limiting conditions. The invention also provides hitherto unknown TPS-encoding and TPP-encoding nucleic acids, and constructs comprising the same, useful in performing the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early may also be important factors in determining yield. Optimizing the abovementioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

A further important trait is that of improved abiotic stress tolerance. Abiotic stress is a primary cause of crop loss worldwide, reducing average yields for most major crop plants by more than 50% (Wang et al., Planta 218, 1-14, 2003). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

A trait of emerging importance is improved Nitrogen use efficiency. Nitrogen (N) is one of the major nutritional elements required for plant growth, which is usually the rate-limiting element in plant growth. Nitrogen is part of numerous important compounds found in living cells, like amino acids, proteins (e.g. enzymes), nucleic acids, and chlorophyll. 1.5% to 2% of plant dry matter is nitrogen and approximately 16% of total plant protein. Thus, the availability of nitrogen has a major impact on amino acid synthesis as well as amino acid composition, accumulation of amino acids, on protein synthesis and accumulation thereof, and based thereupon it is a major limiting factor for plant growth and yield (Frink C. R., Proc. Natl. Acad. Sci. USA 96, 1175 (1999)).

Because of the high nitrogen requirements for crop plants, nitrogen fertilization is a major worldwide agricultural investment, with 80 million metric tons of nitrogen fertilizers (as nitrate and/or ammonium) applied annually (Frink C. R., Proc. Natl. Acad. Sci. USA 96, 1175 (1999)). There are also negative environmental consequences for the extensive use of nitrogen containing fertilizers in crop production since the crops retain only about two-thirds of the applied nitrogen. Therefore high inputs of fertilizer are followed by large outputs by leaching, gaseous losses and crop removal. The unabsorbed nitrogen can subsequently leach into the soil and contaminate water supplies (Frink C. R., Proc. Natl. Acad. Sci. USA 96, 1175 (1999)). Because of the high leaching losses of nitrogen from agricultural ecosystems to surface water and groundwater, nitrogen is also recognized as an pollutant. Nitrogen leaching, namely as nitrate from agricultural lands, affects drinking waterquality and causes eutrophication of lakes and coastal areas. Abundant use of nitrogen containing fertilizers can further lead to final deterioration of soil quality, to environmental pollution and health hazards.

Because of the high costs of nitrogen fertilizer in relation to the revenues for agricultural products, and additionally its deleterious effect on the environment, it is desirable to develop strategies to reduce nitrogen input and/or to optimize nitrogen uptake and/or utilization of a given nitrogen availability while simultaneously maintaining optimal yield, productivity and quality of photosynthetic active organisms, preferably cultivated plants, e.g. crops. Also it is desirable to obtain "existing" yield of crops with lower fertilizer input and/or higher yield on soils of similar or even poorer quality. Therefore, there is still a need for photosynthetic active organisms, especially daily plants, with increased yield, in particular an increased yield-related trait, e.g. an increased nutrient use efficiency, such as plants that are capable to use nitrogen more efficiently so that less nitrogen is required for the same yield or higher yields may be obtained with current levels of nitrogen use. In addition, there is still a need for photosynthetic active organism, especially plants, to increase number of flowers, fruits and biomass production. It is an object of this invention to provide methods for increasing yield of a plant, in particular yield-related traits such as increased number of flowers or seeds or increase biomass, especially under conditions of limited nitrogen supply.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defense mechanisms.

It has now been found that various yield-related traits may be improved in plants by modulating expression in a plant of a nucleic acid encoding a CLC-like (Chloride Channel-like) polypeptide in a plant.

It has now been found that various yield-related traits may be improved in plants by modulating expression in a plant of a nucleic acid encoding an OsBURP-like (BURP-domain containing protein) polypeptide in a plant.

It has now been found that various yield-related traits may be improved in plants by modulating expression in a plant of a nucleic acid encoding an AP2/ERF polypeptide in a plant.

It has now been found that various yield-related traits may be improved in plants by modulating expression in a plant of a nucleic acid encoding a protein fusion comprising a TPS (trehalose-6-phosphate synthase and a TPP trehalose-6-phosphate phosphatase polypeptide or modulating one or more nucleic acid encoding a TPS and a TPP enzyme, whether comprised in the same or in separate nucleic acid molecules.

BACKGROUND

1. CLC-Like Polypeptide

Anion channels/transporters play an important role in controlling metabolic processes and directing signalling. These processes include nutrient loading from the root into the xylem, compartmentalisation of metabolites within cells and coupling with proton gradients, regulating gas exchange by stomatal movements. Nitrate and malate represent the majority of anions in a plant cell. Nitrate is a nutrient but can act as a signalling molecule as well. Plants have a sophisticated nitrate uptake system involving both low- and high-affinity transporters, nitrate is next either transported through the xylem to enter into the cellular metabolism or is stored locally. Cells assimilate nitrate via the nitrate reductase pathway or store it in the tonoplast, and a dynamic balance exists between cytosolic and vacuolar nitrate levels, regulated by uptake of extracellular nitrate, storage in the vacuole and anabolism. The discovery of the chloride channel (CLC) family allowed unravelling the mechanism of proton/nitrate exchange between tonoplasts and cytosol. Determination of subcellular localization, expression patterns, and characterization of knockout mutant phenotypes, gave insight in the physiological role of CLC proteins. Phenotypic analyses showed that clca-1 and clca-2 mutant plants have a reduced nitrate compared to that of wild-type in root and shoot tissues. Also clcc and clce mutants showed lower nitrate levels compared to control plants. An overview of the art is provided by De Angeli et al., Phil. Trans. R. Soc. B 364, 195-201, 2009; and the references cited therein. However, still little is know about the precise role of CLC proteins, and the effect of overexpressing CLC genes on plant phenotypes.

2. OsBURP-Like Polypeptide

BURP-domain containing proteins have been first described by Hattori et al. (Mol. Gen. Genet. 1998, Vol. 259, pages 424-428). According to their analyses, the BURP-domain proteins consist of (i) an N-terminal hydrophobic domain, (ii) a short (conserved) segment, (iiii) an optional segment of repeat units, and (iv) the C-terminal BURP domain. Initially, said protein family was divided into four subfamilies named after its most prominent member: BNM2-like, USP-like, RD22-like, and PG1-like subfamily. In a recent study, Ding et al. (Planta 2009, Vol. 230, pages 149-163) identified a total of seven subfamilies, i.e. subfamilies BURP V, VI, and VII in addition to the subfamilies described by Hattori et al. These newly identified subfamilies have in common that they lack the optional segment of repeat units. It was shown by Ding and his colleagues that the majority of members of BURP-domain containing proteins were induced by various stress factors such as drought, salt, cold, and abscisic acid. Furthermore, Yamaguchi-Shinozaki and co-workers reported in several studies that the AtMYC2- and AtMYB2-regulated induction of one member of the BURP-domain containing families, namely RD22, is mediated by abscisic acid (Mol. Gen. Genet., 1993, Vol. 238, pages 17-25; Plant Cell, 1997, Vol. 9, pages 1859-1868; Plant Cell, 2003, Vol. 15, pages 63-78). However, the exact role of the function of BURP-domain containing proteins in plants, particularly in rice, still remains to be elucidated.

3. AP2/ERF Polypeptide

The ERF family is a large gene family of transcription factors and is part of the AP2/ERF superfamily, which also contains the AP2 and RAV families (Riechmann et al., 2000, Science 290: 2105-2110). The AP2/ERF superfamily is defined by the AP2/ERF domain, which consists of about 60 to 70 amino acids and is involved in DNA binding. These three families have been defined as follows. The AP2 family proteins contain two repeated AP2/ERF domains, the ERF family proteins contain a single AP2/ERF domain, and the RAV family proteins contain a B3 domain, which is a DNA-binding domain conserved in other plant-specific transcription factors, including VP1/ABI3, in addition to the single AP2/ERF domain. The ERF family is sometimes further divided into two major subfamilies, the ERF subfamily and the CBF/DREB subfamily (Sakuma et al., 2002, Biochem Biophys Res Commun 290: 998-1009). It has been demonstrated that the AP2/ERF proteins have important functions in the transcriptional regulation of a variety of biological processes related to growth and development, as well as various responses to environmental stimuli. Genes in the AP2 family have been shown to participate in the regulation of developmental processes, e.g. flower development (Elliott et al., 1996, Plant Cell 8: 155-168), spikelet meristem determinacy (Chuck et al., 1998 Genes Dev 12: 1145-1154), leaf epidermal cell identity (Moose and Sisco, 1996 Genes Dev 10: 3018-3027), and embryo development (Boutilier et al., 2002 Plant Cell 14: 1737-1749). Recently, the involvement of members of the RAV family in ethylene response (Alonso et al., 2003 Science 301: 653-657) and in brassinosteroid response (Hu et al., 2004 Cell Res 14: 8-15) was reported. After finding the tobacco ERFs (Ohme-Takagi and Shinshi, 1995 Plant Cell 7: 173-182), many proteins in the ERF family were identified and implicated in many diverse functions in cellular processes, such as hormonal signal transduction (Ohme-Takagi and Shinshi, 1995), response to biotic (Yamamoto et al., 1999 Plant J 20: 571-579; Gu et al., 2000 Plant Cell 12: 771-786) and abiotic stresses (Stockinger et al., 1997 Proc Natl Acad Sci USA 94: 1035-1040; Liu et al., 1998 Plant Cell 10: 1391-1406; Dubouzet et al., 2003 Plant J 33: 751-763), and regulation of metabolism (van der Fits and Memelink, 2000 Science 289: 295-297; Aharoni et al., 2004 Plant Cell 16: 2463-2480; Broun et al., 2004 Proc Natl Acad Sci USA 101: 4706-4711; Zhang et al., 2005 Plant J 42: 689-707), and in developmental processes (van der Graaff et al., 2000 Development 127: 4971-4980; Banno et al., 2001 Plant Cell 13: 2609-2618; Chuck et al., 2002 Science 298: 1238-1241) in various plant species. After the sequencing of the *Arabidopsis* genome was completed (*Arabidopsis* Genome Initiative, 2000), 145 genes were postulated to encode proteins containing the AP2/ERF domain, with 83% (121 genes) of these genes belonging to the ERF family (Sakuma et al., 2002 Biochem Biophys Res Commun 290: 998-1009). To date, most of the members of the ERF family have yet to be studied, despite the likelihood that these genes play important roles in many physiological aspects in plants. A great deal of experimental work will be required to determine the specific biological function of each of these genes. On the basis of phylogenetic analyses, it has become apparent that a large gene family of transcription factors consists of subgroups of genes that are closely related to each other (Kranz et al., 1998 Plant J 16: 263-276; Parenicova et al., 2003 Plant Cell 15: 1538-1551; Toledo-Ortiz et al., 2003 Plant Cell 15: 1749-1770; Reyes et al., 2004 Plant Physiol 134: 1718-1732; Tian et al., 2004 Plant Mol Biol 54: 519-532). At least two subfamilies were studied by Nakano et al. (Plant Physiology, February 2006, 140, pp. 411-432) CBF/DREB subfamily (Group A) and ERF subfamily (Group B) being those subfamilies further subdivided in classes.

4. A Fusion Between a TPS and a TPP Polypeptide

Trehalose phosphate synthase (TPS) is known to catalyse the transfer of glucose from uridine diphosphate glucose (UDP) to glucose-6-phosphate, producing trehalose-6-phosphate (T6P) and UDP, whereas trehalose-6-phosphatase (TPP) hydrolyses T6P to release trehalose. Trehalose, a dimer of glucose, is a sugar of emerging significance and has been described as 'a metabolic regulator that has an impact like that of a hormone' It is believed that the phosphorylated form of trehalose, T6P, is the active component that regulates its effect (Paul, 2007, Current Opinion in Plant Biology, 10:303-309).

Genes encoding TPS and TPP activity have been found in many organisms from *E. coli* to plants. The distribution and structure of the TPS and TPP gene family in *Arabidopsis thaliana* has been reported (Leyman et al. 2001 TRENDS in Plant Science Vol. 6 No. 11 1360-1385). The genes were classified in TPS Class I, TPS Class II and TPP class III, with Class I having TPS activity and Class II and Class III having TPP activity. Representatives of each of these classes are present in other plants.

The manipulation of the trehalose synthesis genes in plants, either TPS or TPP genes has been often associated with pleiotropic effects such as disruption of root, seed development and inflorescence architecture (Romero et al. Planta 1997, 201:293-297; Eastmond et al. Plant J 2002, 29:223-235; Satoh-Nagasawa et al. Nature 2006, 441:227-230). Such effects complicate the use of TPS and TPP genes to increase the yield of crop plants since they typically lowered the yield of the plant. Presumably such pleiotropic effects may be due to variations of the intracellular levels of T6P (trehalose-6-phosphate) (WO9726357).

Fusion of TPS and TPP enzymatic activity in a single polypeptide has been previously reported either from natural or from synthetic origin (Seo et. al. Applied and environmental microbiology, 66, p. 2484-2490; Chung, Saline Systems 2008, 4:18). Plants transformed with a fusion of a TPS and a TPP enzyme were shown to have increased abiotic stress tolerance (Garg et al. PNAS 2002_vol. 99__15898-15903).

Generally, effects of trehalose genes on plant development are attributed to alteration in intracellular levels of T6P while increase in stress tolerance is attributed to alteration in trehalose levels.

In an attempt to increase stress tolerance by increasing the levels of trehalose in a plant without significantly altering the intracellular availability of T6P, a protein fusion between a TPS and a TPP active portion was overexpressed in rice plants. As expected no T6P-associated pleitropic effects negatively affecting yield of the plants were observed. However and contrary to expectations the development of the plants was altered such that the plants produced more inflorescences (panicles) and more seeds. These effects were observed in the absence of abiotic stress, furthermore it was more prominent under Nitrogen deficiency. Most surprising was the effect of increasing the number of florets in a plant. This finding suggest a role for trehalose beyond that of T6P in flower development in plant.

Production of florets in plants requires the transformation of vegetative meristems in floral meristems, the establishment of such floral meristems and the successful patterning of the meristem. Many genes have been involved in the control of these processes, for example genes controlling auxin and ABA levels (PINI, NCED3; farnesyl transferase, AP1), and sugar metabolism (B-amylases, genes of the shikimate pathway) are involved in transition from vegetative to floral meristem. Establishment of the meristems involve genes such as STM, Wuschel, Clavata and knotted-like. Appropriate patterning of the floral meristem further involves hormonal action such as brasinosteroids mediated by genes such as BZR1 and also floral homeotic transcription factors (MADS-Box, Fruitful, AP1, Sepallata).

SUMMARY

Surprisingly, it has now been found that modulating expression of a nucleic acid encoding a CLC-like polypeptide, or an OsBURP-like polypeptide, or an AP2/ERF polypeptide, gives plants having enhanced yield-related traits, in particular increased yield relative to control plants.

According to one embodiment, there is provided a method for improving yield-related traits in plants relative to control plants, comprising modulating expression in a plant of a nucleic acid encoding a CLC-like polypeptide, or an OsBURP-like polypeptide, or an AP2/ERF polypeptide.

Concerning a fusion between a TPS and TPP polypeptide, it now has surprisingly been found that modulating expression of a nucleic acid encoding a fusion between a TPS and TPP polypeptide gives plants having enhanced yield-related traits, in particular increased number of florets relative to control plants, especially under N deficiency growth conditions.

According to one embodiment, there is provided a method for improving yield-related traits in plants relative to control plants, comprising modulating expression in a plant of a nucleic acid encoding a fusion between a TPS and TPP polypeptide.

DEFINITIONS

The following definitions will be used throughout the present specification.
Polypeptide(s)/Protein(s)
The terms "polypeptide" and "protein" are used interchangeably herein and refer to amino acids in a polymeric form of any length, linked together by peptide bonds.
Polynucleotide(s)/Nucleic Acid(s)/Nucleic Acid Sequence(s)/Nucleotide Sequence(s)
The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.
Homologue(s)
"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

| Examples of conserved amino acid substitutions | |
|---|---|
| Residue | Conservative Substitutions |
| Ala | Ser |
| Arg | Lys |
| Asn | Gln; His |
| Asp | Glu |
| Gln | Asn |

TABLE 1-continued

Examples of conserved amino acid substitutions

| Residue | Conservative Substitutions |
| --- | --- |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain, Motif/Consensus Sequence/Signature

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol. 147(1); 195-7).

Reciprocal BLAST

Typically, this involves a first BLAST involving BLASTing a query sequence (for example using any of the sequences listed in Table A of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The $T_m$ is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The $T_m$ may be calculated using the following equations, depending on the types of hybrids:

1) DNA-DNA hybrids (Meinkoth and Wahl, Anal. Biochem., 138: 267-284, 1984):

$$T_m = 81.5° C. + 16.6 \times \log_{10}[Na^+]^a + 0.41 \times \%[G/C^b] - 500 \times [L^c]^{-1} - 0.61 \times \% \text{ formamide}$$

2) DNA-RNA or RNA-RNA hybrids:

$$T_m = 79.8° C. + 18.5(\log_{10}[Na^+]_a) + 0.58(\% G/C^b) + 11.8(\% G/C^b)^2 - 820/L^c$$

3) oligo-DNA or oligo-RNAs hybrids:

For <20 nucleotides: $T_m = 2(I_n)$

For 20-35 nucleotides: $T_m = 22 + 1.46(I_n)$

[a] or for other monovalent cation, but only accurate in the 0.01-0.4 M range.
[b] only accurate for % GC in the 30% to 75% range.
[c] L=length of duplex in base pairs.
[d] oligo, oligonucleotide; $I_n$=effective length of primer=2× (no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Construct

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
| --- | --- |
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |

TABLE 2a-continued

Examples of constitutive promoters

| Gene Source | Reference |
| --- | --- |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
| --- | --- |
| RCc3 | Plant Mol Biol. 1995 January; 27(2): 237-48 |
| Arabidopsis PHT1 | Koyama et al. J Biosci Bioeng. 2005 January; 99(1): 38-42.; Mudge et al. (2002, Plant J. 31: 341) |
| Medicago phosphate transporter | Xiao et al., 2006, Plant Biol (Stuttg). 2006 July; 8(4): 439-49 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |
| SbPRP1 | Suzuki et al., Plant Mol. Biol. 21: 109-119, 1993. |

TABLE 2b-continued

Examples of root-specific promoters

| Gene Source | Reference |
| --- | --- |
| LRX1 | Baumberger et al. 2001, Genes & Dev. 15: 1128 |
| BTG-26 *Brassica napus* | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 17 (6): 1139-1154 |
| KDC1 (*Daucus carota*) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (*Arabidopsis*) | Diener et al. (2001, Plant Cell 13: 1625) |
| NRT2;1Np (*N. plumbaginifolia*) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
| --- | --- |
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| *sorghum* α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d examples of endosperm-specific promoters

| Gene source | Reference |
|---|---|
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| *sorghum* kafirin | DeRose et al. (1996) Plant Mol Biol 32: 1029-35 |

TABLE 2e

Examples of embryo specific promoters:

| Gene source | Reference |
|---|---|
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

Examples of aleurone-specific promoters:

| Gene source | Reference |
|---|---|
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

Examples of green tissue-specific promoters

| Gene | Expression | Reference |
|---|---|---|
| Maize Orthophosphate dikinase | Leaf specific | Fukayama et al., Plant Physiol. 2001 November: 127(3): 1136-46 |
| Maize Phosphoenolpyruvate carboxylase | Leaf specific | Kausch et al., Plant Mol Biol. 2001 January; 45(1): 1-15 |
| Rice Phosphoenolpyruvate carboxylase | Leaf specific | Lin et al., 2004 DNA Seq; 2004 August; 15(4): 269-76 |
| Rice small subunit Rubisco | Leaf specific | Nomura et al., Plant Mol Biol. 2000 September; 44(1): 99-106 |
| rice beta expansin EXBP9 | Shoot specific | WO 2004/070039 |
| Pigeonpea small subunit Rubisco | Leaf specific | Panguluri et al., Indian J Exp Biol. 2005 April; 43(4): 369-72 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

Examples of meristem-specific promoters

| Gene source | Expression pattern | Reference |
|---|---|---|
| rice OSH1 | Shoot apical meristem, from embryo globular stage to seedling stage | Sato et al. (1996) Proc. Natl. Acad. Sci. USA, 93: 8117-8122 BAD87835.1 |
| Rice metallothionein | Meristem specific | |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luciferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or
(b) genetic control sequence(s) which is operably linked with the nucleic acid sequence according to the invention, for example a promoter, or
(c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not present in, or originating from, the genome of said plant, or are present in the genome of said plant but not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

It shall further be noted that in the context of the present invention, the term "isolated nucleic acid" or "isolated polypeptide" may in some instances be considered as a synonym for a "recombinant nucleic acid" or a "recombinant polypeptide", respectively and refers to a nucleic acid or polypeptide that is not located in its natural genetic environment and/or that has been modified by recombinant methods.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. For the purposes of this invention, the original unmodulated expression may also be absence of any expression. The term "modulating the activity" shall mean any change of the expression of the inventive nucleic acid sequences or encoded proteins, which leads to increased yield and/or increased growth of the plants. The expression can increase from zero (absence of, or immeasurable expression) to a certain amount, or can decrease from a certain amount to immeasurable small amounts or zero.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level. For the purposes of this invention, the original wild-type expression level might also be zero, i.e. absence of expression or immeasurable expression.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an ortho- logue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. miRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen. Genet. 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain portion is transformed and thus transgenic [Feldman, K A and Marks M D (1987). Mol Gen Genet. 208:1-9; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol. Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

The genetically modified plant cells can be regenerated via all methods with which the skilled worker is familiar. Suitable methods can be found in the above-mentioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet. 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J. 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield Related Traits

Yield related traits are traits or features which are related to plant yield. Yield-related traits may comprise one or more of the following non-limitative list of features: early flowering time, yield, biomass, seed yield, early vigour, greenness index, increased growth rate, improved agronomic traits, such as e.g. improved Water Use Efficiency (WUE), improved Nitrogen Use Efficiency (NUE), etc.

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters.

The terms "yield" of a plant and "plant yield" are used interchangeably herein and are meant to refer to vegetative biomass such as root and/or shoot biomass, to reproductive organs, and/or to propagules such as seeds of that plant.

Taking corn as an example, male inflorescences (tassels) and female inflorescences (ears). The female inflorescence produces pairs of spikelets on the surface of a central axis (cob). Each of the female spikelets encloses two fertile florests, one of whose will usually mature into a maize kernel once fertilized. Hence a yield increase in maize may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate, which is the number of filled florets (i.e. florets containing seed) divided by the total number of florets and multiplied by 100), among others.

Inflorescences in rice plants are called panicles. The panicle bears spikelets. The spikelet is the basic unit of the panicles and consists of a pedicel and a floret. The floret is born on the pedicel. A floret includes a flower that is covered by two protective glumes: a larger glume (the lemma) and a shorter glume (the palea). Hence, taking rice as an example, a yield increase may manifest itself as an increase in one or more of the following: number of plants per square meter, number of panicles per plant, panicle length, number of spikelets per panicle, number of flowers (or florets) per panicle, increase in the seed filling rate which is the number of filled florets (i.e. florets containing seeds divided by the total number of florets and multiplied by 100), increase in thousand kernel weight, among others. In rice, submergence tolerance may also result in increased yield.

Early Flowering Time

Plants having an "early flowering time" as used herein are plants which start to flower earlier than control plants. Hence this term refers to plants that show an earlier start of flowering. Flowering time of plants can be assessed by counting the number of days ("time to flower") between sowing and the emergence of a first inflorescence. The "flowering time" of a plant can for instance be determined using the method as described in WO 2007/093444.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increased Growth Rate

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

Stress Resistance

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35%, 30% or 25%, more preferably less than 20% or 15% in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. "Mild stresses" are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures.

"Biotic stresses" are typically those stresses caused by pathogens, such as bacteria, viruses, fungi, nematodes and insects.

The "abiotic stress" may be an osmotic stress caused by a water stress, e.g. due to drought, salt stress, or freezing stress. Abiotic stress may also be an oxidative stress or a cold stress. "Freezing stress" is intended to refer to stress due to freezing temperatures, i.e. temperatures at which available water molecules freeze and turn into ice. "Cold stress", also called "chilling stress", is intended to refer to cold temperatures, e.g. temperatures below 10°, or preferably below 5° C., but at which water molecules do not freeze. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% A of the average production of such plant in a given environment. Average production may be calculated on harvest and/or season basis. Persons skilled in the art are aware of average yield productions of a crop.

In particular, the methods of the present invention may be performed under non-stress conditions. In an example, the methods of the present invention may be performed under non-stress conditions such as mild drought to give plants having increased yield relative to control plants.

In another embodiment, the methods of the present invention may be performed under stress conditions.

In an example, the methods of the present invention may be performed under stress conditions such as drought to give plants having increased yield relative to control plants.

In another example, the methods of the present invention may be performed under stress conditions such as nutrient deficiency to give plants having increased yield relative to control plants.

Nutrient deficiency may result from a lack of nutrients such as nitrogen, phosphates and other phosphorous-containing compounds, potassium, calcium, magnesium, manganese, iron and boron, amongst others.

In yet another example, the methods of the present invention may be performed under stress conditions such as salt stress to give plants having increased yield relative to control plants. The term salt stress is not restricted to common salt (NaCl), but may be any one or more of: NaCl, KCl, LiCl, $MgCl_2$, $CaCl_2$, amongst others.

In yet another example, the methods of the present invention may be performed under stress conditions such as cold stress or freezing stress to give plants having increased yield relative to control plants.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following:

(a) an increase in seed biomass (total seed weight) which may be on an individual seed basis and/or per plant and/or per square meter;
(b) increased number of flowers per plant;
(c) increased number of seeds;
(d) increased seed filling rate (which is expressed as the ratio between the number of filled florets divided by the total number of florets);
(e) increased harvest index, which is expressed as a ratio of the yield of harvestable parts, such as seeds, divided by the biomass of aboveground plant parts; and
(f) increased thousand kernel weight (TKW), which is extrapolated from the number of seeds counted and their total weight. An increased TKW may result from an increased seed size and/or seed weight, and may also result from an increase in embryo and/or endosperm size.

The terms "filled florets" and "filled seeds" may be considered synonyms.

An increase in seed yield may also be manifested as an increase in seed size and/or seed volume. Furthermore, an increase in seed yield may also manifest itself as an increase in seed area and/or seed length and/or seed width and/or seed perimeter.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Biomass

The term "biomass" as used herein is intended to refer to the total weight of a plant. Within the definition of biomass, a distinction may be made between the biomass of one or more parts of a plant, which may include any one or more of the following:

aboveground parts such as but not limited to shoot biomass, seed biomass, leaf biomass, etc.;
aboveground harvestable parts such as but not limited to shoot biomass, seed biomass, leaf biomass, etc.;
parts below ground, such as but not limited to root biomass, etc.;
harvestable parts below ground, such as but not limited to root biomass, etc.;
vegetative biomass such as root biomass, shoot biomass, etc.;
reproductive organs; and
propagules such as seed.

Marker Assisted Breeding

Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Use as Probes in (Gene Mapping)

Use of nucleic acids encoding the protein of interest for genetically and physically mapping the genes requires only a nucleic acid sequence of at least 15 nucleotides in length. These nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acids encoding the protein of interest. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding the protein of interest in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eragrostis tef*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Tripsacum dactyloides*, *Triticosecale rimpaui*, *Triticum* spp. (e.g. *Triticum aestivum*, *Triticum* durum, *Triticum turgidum*, *Triticum hybernum*, *Triticum macha*, *Triticum sativum*, *Triticum monococcum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

DETAILED DESCRIPTION OF THE INVENTION

Surprisingly, it has now been found that modulating expression in a plant of a nucleic acid encoding a CLC-like polypeptide, or an OsBURP-like polypeptide, or an AP2/ERF polypeptide gives plants having enhanced yield-related traits relative to control plants. According to a first embodiment, the present invention provides a method for enhancing yield-related traits in plants relative to control plants, comprising modulating expression in a plant of a nucleic acid encoding a CLC-like polypeptide, or an OsBURP-like polypeptide, or an AP2/ERF polypeptide and optionally selecting for plants having enhanced yield-related traits.

Furthermore, concerning a TPS-TPP protein fusion, it now has surprisingly been found that modulating expression in a plant of (i) a nucleic acid encoding a TPS-TPP protein fusion: which is a fusion between a TPS polypeptide or an active portion thereof and a TPP polypeptide or an active portion thereof; or (ii) of a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules gives plants having enhanced yield-related traits relative to control plants.

According to a first embodiment, the present invention provides a method for enhancing yield-related traits in plants relative to control plants, comprising modulating expression in a plant of (i) a nucleic acid encoding a TPS-TPP protein fusion: fusion between a TPS polypeptide or an active portion thereof and a TPP polypeptide or an active portion thereof; or (ii) of a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules gives plants having enhanced yield-related traits relative to control plants and optionally selecting for plants having enhanced yield-related traits.

A preferred method for modulating, preferably increasing expression of a nucleic acid encoding a CLC-like polypeptide, or an OsBURP-like polypeptide, or an AP2/ERF polypeptide is by introducing and expressing in a plant a nucleic acid encoding a CLC-like polypeptide, or an OsBURP-like polypeptide, or an AP2/ERF polypeptide, respectively.

Concerning a TPS-TPP protein fusion, a preferred method for modulating, preferably, increasing expression of a nucleic acid encoding a TPS and a TPP polypeptide is by introducing and expressing in a plant a nucleic acid encoding a fusion between a TPS and a TPP polypeptide or active fragment of any thereof or by introducing and expressing separately the TPS and the TPP nucleic acids whether in a single or in multiple molecules.

In one embodiment, in particular concerning CLC-like polypeptides, any reference hereinafter to a "protein useful in the methods of the invention" is taken to mean a CLC-like polypeptide as defined herein. Any reference hereinafter to a "nucleic acid useful in the methods of the invention" is taken to mean a nucleic acid capable of encoding such a CLC-like polypeptide. The nucleic acid to be introduced into a plant (and therefore useful in performing the methods of the invention) is any nucleic acid encoding the type of protein which will now be described, hereafter also named "CLC-like nucleic acid" or "CLC-like gene".

A "CLC-like polypeptide" as defined herein refers to any polypeptide comprising a Voltage CLC domain (Pfam entry PF00654) and C-terminally thereof a CBS domain (Pfam entry PF00571). CLC-like polypeptides are part of a family of voltage-gated channels that is highly conserved over various kingdoms of life and are structurally unrelated to the other known voltage-gated channels. They are found in organisms ranging from bacteria to yeasts and plants, and also in animals. CLC-like polypeptides typically have 10 or 12 transmembrane (TM) domains, occasionally less than 10 TM domains. The CLC-like polypeptide represented by SEQ ID NO: 2 for example is predicted to have eight TM domains. CBS (cystathionine-beta-synthase) domains are small intracellular modules, mostly found in two or four copies within a protein (two copies for CLC-like proteins), and are present in several different proteins in all kingdoms of life. Tandem pairs of CBS domains can act as binding domains for adenosine derivatives and may regulate the activity of attached enzymatic or other domains.

Preferably, the CLC-like polypeptide useful in the methods of the present invention comprises one or more of the motifs 1 to 8:

```
Motif 1
                                                       (SEQ ID NO: 83)
(S/C/A/G/P)(H/Y/P/G)(I/V/M)(E/Q/N)SLDYE(I/V/L)(N/A/F/I/V)(E/D).

Preferably, motif 1 is:
                                                       (SEQ ID NO: 492)
(S/C/A/G/P)(H/Y/P/G)(I/V/M)(E/N)SLDYE(I/V/L)(N/A/F/I/V)E.

More preferably, motif 1 is:
                                                       (SEQ ID NO: 493)
(S/A/G/P)(H/Y/P/G)(I/V/M)(E/N)SLDYE(I/V/L)(N/I/V)E Motif 2
                                                       (SEQ ID NO: 84)
P(T/A/S)A(A/G/T)G(P/S)GI(P/S)E(V/I)K(A/G)YLNG(I/V)D.

Preferably, motif 2 is:
                                                       (SEQ ID NO: 494)
P(T/A/S)AAG(P/S)GIPE(V/I)K(A/G)YLNG(I/V)D Motif 3
                                                       (SEQ ID NO: 85)
G(S/C/N)I(G/C/F/L/A/S/T)(A/S/G)V(A/S/G)(A/S/G)(G/S)(L/F)(D/A/L/V/I/H/F)

(L/V/I)GK(E/A)GP(L/M).

Preferably, motif 3 is:
                                                       (SEQ ID NO: 495)
G(S/C/N) I(G/C/F/A/S/T) (A/S/G)V(A/S/G)(A/S/G)(G/S)

(L/F)(D/A/L/V/I/H/F)(L/V/I)GK(E/A)GP(L/M).

More preferably, motif 3 is:
                                                       (SEQ ID NO: 496)
GSI(G/C)(A/S)V(A/S/G)(A/S/G)GL(D/A/I)(L/V)GKEGPL.
```

```
Motif 4
                                                            (SEQ ID NO: 86)
PVGGVLFALE(E/A/S/G)(V/A/L/M)(A/T/S)(T/S)W(W/S)(R/A).

Preferably, motif 4 is:
                                                            (SEQ ID NO: 497)
PVGGVLFALEEV(A/T)(T/S)WWR.

Motif 5
                                                            (SEQ ID NO: 87)
(G/D)(K/R/N/HI)CG(L/M/H)(F/A)G(S/K/E/Q)GG(L/F)I(M/L/I)(F/Y/W)D.

Preferably, motif 5 is:
                                                            (SEQ ID NO: 498)
G(K/R/N/H/I) CG(L/M/H)(F/A)G (S/K/E/G)GG(L/F)I(M/L/I) (F/Y/W) D.

Motif 6
                                                            (SEQ ID NO: 88)
YN(D/N/G/A)(L/M)(S/A).

Preferably, motif 6 is:
                                                            (SEQ ID NO: 499)
YN(D/G/A)(L/M)(S/A).

More preferably, motif 6 is:
                                                            (SEQ ID NO: 500)
YNDL(S/A).

Motif 7
                                                            (SEQ ID NO: 89)
G(S/T)(M/L)R(M/T)TVS(L/V/T).

Preferably, motif 7 is:
                                                            (SEQ ID NO: 501)
GSMRMTVSL.

Motif 8
                                                            (SEQ ID NO: 90)
M(F/I/L/V/M)VL(L/F/V)(I/V)(A/S)K(T/A/S)(V/I)(G/A)(D/N)(S/AF/I/C/N/G/V)
FN.

Preferably, motif 8 is:
                                                            (SEQ ID NO: 502)
M (F/I/L/V/M) VL(L/F/V) (I/V)(A/S) K(T/A/S)V (G/A)

(D/N)(S/A/F/C/G/V)FN.

More preferably, motif 8 is:
                                                            (SEQ ID NO: 503)
M(F/I/L)VLLI(A/S)K(T/A)VGD(S/A/F)FN.
```

Further preferably, the CLC-like polypeptide comprises in increasing order of preference, at least 2, at least 3, at least 4, at least 5, at least 6, at least 7, or all 8 motifs.

Additionally or alternatively, the homologue of a CLC-like protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2, provided that the homologous protein comprises any one or more of the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in a CLC-like polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one or more of the motifs represented by SEQ ID NO: 83 to SEQ ID NO: 90 and SEQ ID NO: 492 to 503 (Motifs 1 to 8).

In another embodiment, in particular concerning OsBURP-like polypeptides, any reference hereinafter to a "protein useful in the methods of the invention" is taken to mean an OsBURP-like polypeptide as defined herein. Any reference hereinafter to a "nucleic acid useful in the methods of the invention" is taken to mean a nucleic acid capable of encoding such an OsBURP-like polypeptide. The nucleic acid to be introduced into a plant (and therefore useful in performing the methods of the invention) is any nucleic acid encoding the type of protein which will now be described, hereafter also named "OsBURP-like nucleic acid" or "OsBURP-like gene".

An "OsBURP-like polypeptide" as defined herein refers to any BURP domain-containing protein comprising a BURP domain (Pfam accession PF03181) and further comprising motifs 9, 10 and 11, or a motif having not more than 2 mismatches to motifs 9 to 11.

```
Motif 9 (SEQ ID NO: 140):
[HE][EK][HK]YCATSLESM[VI][DE][LF][SVA][TA]S[KS]LG

Motif 10 (SEQ ID NO: 141):
V[VA]CH[RK][QEM][NP]Y[AP]YAVF[YG][VC]H[KGT][TIS][KE][AGT][AT]

Motif 11 (SEQ ID NO: 142):
[AP][VK][AH][EL]A[YF][QK][RV]L[KG]V[AK]PG[TKS]V[PA]VCHFLPQD[DH][VMI][VL]W
```

Additionally or alternatively, the OsBURP-like polypeptide comprises one or more of the motifs 12 to 24.

```
Motif 12 (SEQ ID NO: 143):
[FL]LPR[GQ][VR]ADS[IV]PF[SA]S[EDN]KLPEI[LF][NS][KQR][FL]S[VI][PK][PA]G Motif 13 (SEQ ID NO: 144):
[SL][PST][AP]E[MQ]YW[KS][IS][AK]LP[NT][TS]P[MI]P[KG][AS][IV][KR]D[LI][IL][SH]P[DA]

[SL]S[AE][AE][KS]

Motif 14 (SEQ ID NO: 145):
[AE][ST][KQ][LDI][KH][DE]D[TP][NVT][GV][SA][VL]FFLE[KE]D[LM][HFR]PG[KSA][KT]M

[NT]LHF

Motif 15 (SEQ ID NO: 146):
DGT[RMK][AV][KE]A[VL]A[AV]CH[TGA]D[TV]

Motif 16 (SEQ ID NO: 147):
S[PV][ETK]A[DE]A[AM][MV][RK][SN][LT][IL][AK][VE]CE

Motif 17 (SEQ ID NO: 148):
[KG][PQ][TS]P[MR]Q[AK]Y[RT][IV][AET]A[GVA][RV][KPR]

Motif 18 (SEQ ID NO: 149):
AY[MT]V[TP]L[EA]G

Motif 19 (SEQ ID NO: 150):
[KG][HE][KA][HK][AY]CATSLESMV[ED][LF][AV][AT]SSLGT[RS][DH][VI][RH]A[VA]ST[EV]V Motif 20 (SEQ ID NO: 151)
[HA][EV]A[FY][KQ][VR]L[GK]V[KA]PG[TKS]V[AP]VCHF[LM]PQD[HD][VM][VL]W[VT][RS]

Motif 21 (SEQ ID NO: 152)
[AK][FL]LPRG[RE]A[DE][SA][VI]PF[AS]SEKL[PS]EILS[QR][FL][SG][VI]P[AP]

Motif 22 (SEQ ID NO: 153)
[KH]YCATSLES[ML]VE[FL][AV]ASSLGTRD[VI][HR]AVSTE

Motif 23 (SEQ ID NO: 154)
[VA]RPV[PS]V[SP]GGDMV[AT]CH[GRD]M[AP]Y[AP]YAV[FY]G[VC]H[TG][IT]

Motif 24 (SEQ ID NO: 155)
KEDT[VT]G[SN]VFFLEKDL[FR]PGSK[MIL]TLHF[TP][RP]AT
```

Motifs 9 to 24 were derived using the MEME algorithm (Bailey and Elkan, Proceedings of the Second International Conference on Intelligent Systems for Molecular Biology, pp. 28-36, AAAI Press, Menlo Park, Calif., 1994). At each position within a MEME motif, the residues are shown that are present with a frequency higher than 0.2. Residues within square brackets represent alternatives.

Preferably, the "OsBURP-like polypeptide" comprises (i) an N-terminal hydrophobic domain—a presumptive transit peptide, joined to (ii) a short conserved segment or other short segment, (iii) optionally, a segment consisting of repeated units, and (iv) the C-terminal BURP domain (Hattori et al., 1998).

More preferably, the OsBURP-like polypeptide comprises in increasing order of preference, at least 2, at least 3, at least 4, at least 5, at least 6, at least 7, at least 8, at least 9, at least 10, at least 11, at least 12, at least 13, at least 14, at least 15, or all 16 motifs.

Additionally or alternatively, the homologue of an OsBURP-like protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 95, provided that the homologous protein comprises any one or more of the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in an OsBURP-like polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one or more of the motifs represented by SEQ ID NO: 140 to SEQ ID NO: 155 (Motifs 9 to 24).

In yet another embodiment, in particular with regard to AP2/ERF-like polypeptides, any reference hereinafter to a "protein useful in the methods of the invention" is taken to mean an AP2/ERF polypeptide as defined herein. Any reference hereinafter to a "nucleic acid useful in the methods of the invention" is taken to mean a nucleic acid capable of encoding such an AP2/ERF polypeptide. The nucleic acid to be introduced into a plant (and therefore useful in performing the methods of the invention) is any nucleic acid encoding the type of protein which will now be described, hereafter also named "AP2/ERF nucleic acid" or "AP2/ERF gene".

An "AP2/ERF polypeptide" as defined herein refers to any polypeptide comprising at least one "APETALA2/ethylene-responsive element-binding factor", i.e. an AP2/ERF domain, with a PFam accession number PF00847, which consists of about 60 to 70 amino acids and is involved in DNA binding activity.

Preferably, the AP2/ERF domain of an AP2/ERF polypeptide has at least, in increasing order of preference, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the SEQ ID NO 160.

Additionally or alternatively, the AP2/ERF polypeptide useful in the methods of the invention comprises one or more sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the Motif 25:

The "X" in the sequence indicates no conservation at this position.

```
Motif 25:
                                    (SEQ ID NO: 265)
GXRXRXWGXWVXEIRXPXXXXRXWLGSXXXXXXAAXAXDXA
```

Motif 25 is typically found in any AP2/ERF polypeptide of any origin.

In another preferred embodiment of the present invention the AP2/ERF polypeptide of the invention may comprises Motif 25 and at least one of the Motifs 26, 27 and 28 as defined above, or may comprise a motif having, in increasing order of preference at least 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to any one or more of Motifs 26 to 28:

```
Motif 26:
                                    (SEQ ID NO: 266)
IXXXA

Motif 27:
                                    (SEQ ID NO: 267)
DXNXXP

Motif 28:
                                    (SEQ ID NO: 268)
LWXF
```

In another preferred embodiment of the present invention the AP2/ERF polypeptide of the invention may comprises Motif 25 and Motif 26 and Motif 27 or Motif 28 as defined above, or may comprise a motif having, in increasing order of preference at least 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to any one or more of Motifs 26 to 28.

Motifs 26, 27 and 28 correspond to a consensus sequences which represent conserved protein regions in an AP2/ERF polypeptide of classes IIa, IIb and IIc origin, to which *Medicago truncatula* and *Arabidopsis thaliana* belong.

In another preferred embodiment of the present invention the AP2/ERF polypeptide of the invention may comprise Motif 26 and Motif 27 as defined above.

In another preferred embodiment of the present invention the AP2/ERF polypeptide of the invention may comprise Motif 25, Motif 26 and Motif 27 or Motif 28 as defined above.

In one most preferred embodiment of the present invention the AP2/ERF polypeptide of the invention may comprise Motif 25, Motif 26 and Motif 28 as defined above.

The most preferred embodiment of the present invention the AP2/ERF polypeptide of the invention may comprise Motif 25, Motif 26 and Motif 27 as defined above.

MEME algorithm (Bailey and Elkan, Proceedings of the Second International Conference on Intelligent Systems for Molecular Biology, pp. 28-36, AAAI Press, Menlo Park, Calif., 1994) was used for motif determination.

Additionally or alternatively, the homologue of a AP2/ERF protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 160, provided that the homologous protein comprises any one or more of the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in a AP2/ERF polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one or more of the motifs represented by SEQ ID NO: 265 to SEQ ID NO: 268 (Motifs 25 to 28).

In one embodiment, in particular concerning a TPS-TPP proteins fusion, any reference hereinafter to a "protein useful in the methods of the invention" is taken to mean a TPS and/or a TPP polypeptide and or a TPS-TPP fusion between the same as defined herein. Any reference hereinafter to a "nucleic acid useful in the methods of the invention" is taken to mean a nucleic acid capable of encoding such a TPS, TPP or TPS-TPP polypeptide. The nucleic acid to be introduced into a plant (and therefore useful in performing the methods of the invention) is any nucleic acid encoding the type of protein which will now be described, hereafter also named TPS, TPP or TPS-TPP nucleic acid, or TPS, TPP or TPS-TPP gene.

Concerning TPS

A "TPS polypeptide" as defined herein refers to any polypeptide having trehalose-6-phosphate synthase activity. Methods to determine trehalose-6-phosphate synthase activity are well known in the art. Further details are provided in the Examples section.

Additionally or alternatively a TPS polypeptide useful in the methods of the invention comprises a Glycosyl transferase domains (Pfam accession number: PF0098).

A preferred Glycosyl transferase domain comprised in a TPS polypeptide useful in the methods of the invention has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to any one or more of the Glycosyl transferase domains as present in any of the polypeptides of Tables A4 to A6, more preferably as present in SEQ ID NO: 273 or SEQ ID NO: 441 (see Example section).

A further preferred TPS polypeptide useful for the methods of the invention comprises a conserved motif having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to any one or more of motifs:

More preferably, the TPS polypeptide comprises in increasing order of preference, at least 2, preferably 3 of the motifs above referenced.

Also useful in the methods of the invention are TPS homologues proteins to the *E. coli* TPS protein encoded by the OtsA gene.

Additionally or alternatively, the homologue of a TPS protein useful in the methods of the invention has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides of Table A4, preferably to SEQ ID NO: 273. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered Concerning TPP A "TPP polypeptide" as defined herein refers to any polypeptide having trehalose-6-phosphate phosphatase activity.

Methods to determine trehalose-6-phosphate phosphatase activity are well known in the art. Further details are provided in the Examples section.

Additionally or alternatively a TPP polypeptide useful in the methods of the invention comprises a Trehalose phosphatase (Trehalose_PPase) domain (Pfam accession number: PF02358).

A preferred Trehalose_PPase domain as present in a TPS polypeptide useful in the methods of the invention has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to any one or more of the Trehalose_PPase domains as present

```
(i)
TPS-Motif 29:
                                                        (SEQ ID NO: 458)
Y[EQ]EGDV[VI]WCHDYHLMFLP[KQ][CY]LK[ED][YH][ND][SIN][KN]MKVGWFLH

TPFPSSEI[YH][RK]TLPSR;

(ii)
(ii)TPS-Motif 30:
                                                        (SEQ ID NO: 459)
F[EK]YFTERTPRSHFE[TH][RS]ETS[LF]VWNY[KE]YADVEFGR[LA]QARD[ML]L

QHLW[TA]GPISN;

(iii)
(iii)TPS Motif 31:
                                                        (SEQ ID NO: 460)
GVDRLDMIKGIPQK[IY]LAFEKFLEEN[PA][EN]WRDKVVL[LV]QIAVPTR[TN]DVP

EYQK.
```

The Motifs abovementioned were identified using the polypeptides of Table A4 to A6 and the MEME algorithm (Bailey and Elkan, Proceedings of the Second International Conference on Intelligent Systems for Molecular Biology, pp. 28-36, AAAI Press, Menlo Park, Calif., 1994.)

in any of the polypeptides of Tables A4 to A6, more preferably as present in SEQ ID NO: 441 or SEQ ID NO: 443 (see Example section).

A further preferred polypeptide useful for the methods of the invention comprises a conserved motif having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to any one or more of motifs:

(i)
TPP-Motif 32:
(SEQ ID NO: 461)
G[FW]FLH[ST]PFPSSEIYRTLP[VS]R[DES]E[LI]L[RK][AS][LV]LN[AC]DL[IV]GFH

T[FY]DYARHF[LV]S[CA]C[ST]R;

(ii)
TPP-Motif 33:
(SEQ ID NO: 462)
[FY][KA]G[KR][KT][VL][MLI]LGVD[DR][ML]D[IM][FI]KGI[SP][LQ]K[LI]LA[FM]E[QK]

[LF]LE[QE][HN]P[EK][WL][RQ][GD][KR][VA]VL[VL]QIA[NV]P[AT]R;

(iii)
TPP Motif 34:
(SEQ ID NO: 463)
A[YL]Y[AT][IV][AT][ED][CV][CV][LV]V[TN][AS][VL]RDGMNL[VI][PS]YE[YF][IVT]

[VA]C[RQ].

The motifs TPP Motif 32 to TPP Motif 34 are conserved in TPS and TPP polypeptides.

Even more preferably the TPP polypeptide useful in the methods of the invention comprises a motif having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to any one or more of motifs:

(i)
TPP-Motif 35:
(SEQ ID NO: 464)
GKQIVMFLDYDGTLSPIV[DE]DPDRA[FV]M[ST][DE][EK]MR[ER][AT]V[RK][KG]

[VL]A[KR][HC]FPTAIV[ST]GRC;

(ii)
TPP-Motif 36:
(SEQ ID NO: 465)
QGRKV[LF]E[IV]RP[TS]IKWDKGKALEFLLESLG[FY][AE]N[CS];

(iii)
TPP-Motif 37:
(SEQ ID NO: 466)
P[IV]YIGDDRTDEDAFKVLRNRGQG[FI]GILVS;

(iv)
TPP-Motif 38:
(SEQ ID NO: 467)
F[CA][LV][ST][VW]H[YF]R;

(v)
TPP-Motif 39:
(SEQ ID NO: 468)
LDYDG;

(vi)
TPP-Motif 40:
(SEQ ID NO: 469)
GDDRTD.

Motifs TPP-Motif 37 to TPP-Motif 40 are conserved motifs in class III TPP polypeptides. "A.thaliana_AT1G78090.1#1_Class-III-B" polypeptide of Table A6 is an example of a Class III TPP polypeptide.

Motifs TPP-Motif 39 and TPP-Motif 40 represent a general phosphate box and a phosphatase box-like respectively present in TPP polypeptides which are typically required for phosphatase activity.

Motifs above were identified using the polypeptides of Table A4-A6 and the MEME algorithm (Bailey and Elkan, Proceedings of the Second International Conference on Intelligent Systems for Molecular Biology, pp. 28-36, AAAI Press, Menlo Park, Calif., 1994.)

More preferably, the TPP polypeptide comprises in increasing order of preference, at least 2, 3, 4 of the motifs above, more preferably motifs TPP-Motif 39 (SEQ ID NO: 468) and TPP-Motif 40 (SEQ ID NO: 469).

Also useful in the methods of the invention are TPP homologues proteins to the *E. coli* TPP protein encoded by the OtsB gene.

Additionally or alternatively, the homologue of a TPP polypeptide useful in the methods of the invention has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides of Table A5 more preferably to SEQ ID NO:299, SEQ ID NO: 301 or SEQ ID NO:357. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered Concerning TPS-TPP Polypeptides The term "TPS-TPP polypeptide" as used herein refers to a protein fusion between a TPS and TPP polypeptide or active portions of any thereof. The terms "TPS-TPP nucleic acid" or "TPS-TPP gene" refer to a polynucleotide encoding a TPS-TPP polypeptide.

A "TPS-TPP polypeptide" as defined herein refers to any polypeptide having both activities, trehalose-6-phosphate synthase activity and trehalose-6-phosphate phosphatase activity.

Methods to determine both enzyme activities are well known in the art. Further details on such methods are detailed in the Examples section.

Additionally or alternatively a TPS-TPP polypeptide useful in the methods of the invention comprises a Glycosyl transferase domains (Pfam accession number: PF0098) and a Trehalose phosphatase (Trehalose_PPase) domain (Pfam accession number: PF02358).

The TPS and the TPP portion within the TPS-TPP fusion are as TPS and TPP polypeptides defined above. Active fragments of TPS and TPP polypeptides are useful in the methods of the invention when used in a protein fusion that has both TPS and TPP activity.

Additionally or alternatively, the homologue of a TPS-TPP polypeptide useful in the methods of the invention has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides of Table A6 more preferably to SEQ ID NO: 441, SEQ ID NO: 443 or SEQ ID NO: 445. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

A preferred TPS portion useful in the methods of the invention lacks the inhibitory domain at the N-terminal end described by Van Dijck et al. (2002) in Biochem J 2002, 366:63-71. An Example of such portion is provided in Table A4 as represented by SEQ ID NO: 273 or SEQ ID NO:275.

A TPS-TPP polypeptide of the invention may be of synthetic origin such as the polypeptide represented by SEQ ID NO: 441, SEQ ID NO: 443, SEQ ID NO: 445 or from natural origin such as the polypeptides represented by SEQ ID NO: 446-454.

Methods to synthetically make protein fusions are well known in the art. Plasmid vectors specifically suitable to make proteins fusions and express them into plants have been developed (Karimi et al. Plant Physiol. Vol. 145, 2007). For example methods to make protein or gene fusion involving cloning of end-to-end PCR fragments have been described (Magnani et al. (2006). BMC Mol. Biol. 7:46). The different active portions in a bifunctional protein fusion may be separated by linked as described by Arai et al. (2001). Protein Engineering 14:529-532 or Perham R (1991). Biochemistry 30, 8501-8512. Tools to assist on the design of suitable bifunctional protein fusions have been described (Xue et al. (2004). Nucl. Acid Res. 32:W562-565). Direct gene synthesis is also known in the art. Tools to facilate the design of the gene to be optimized including suitable codon optimisations have been described (Villalobos et al. 2006. BMC Bioinformatics 7:285).

The terms "domain", "signature" and "motif" are defined in the "definitions" section herein.

Concerning CLC-like polypeptides, the polypeptide sequence which when used in the construction of a phylogenetic tree, such as the one depicted in FIG. 3, preferably clusters with the group of CLC-like polypeptides comprising the amino acid sequence represented by SEQ ID NO: 2 rather than with any other anion channel proteins like Aluminium Tolerance (ALMT) Anion Channels or Slow Anion Channels (SLAC), or with the glutamate receptor homologue family (Ward et al, Annu. Rev. Physiol. 71, 59-82, 2009; Brenner et al, Plant Physiol. 124, 1615-1624, 2000).

Furthermore, CLC-like polypeptides (at least in their native form) typically have nitrate/$H^+$ exchanging activity. Tools and techniques for measuring anion transporting activity are well known in the art, for example by complementation of yeast mutants (Marmagne et al., J. Exp. Bot. 58, 3385-3393, 2007) or complementation of *Arabidopsis* mutants (De Angeli, 2009). Further details are provided in Example 6.

In addition, CLC-like polypeptides, when expressed in rice according to the methods of the present invention as outlined in Examples 7 and 8, give plants having increased yield related traits in comparison to control plants, in particular increased seed yield when grown under drought stress conditions.

Concerning osBURP-like polypeptides, the polypeptide sequence which when used in the construction of a phylogenetic tree, such as the one depicted in FIG. 7, preferably clusters with the group of OsBURP-like polypeptides belonging to the BURP V clade as defined by Ding et al., (Planta 2009, Vol. 230, pages 149-163) comprising the amino acid sequence represented by SEQ ID NO: 95 rather than with any other group.

Furthermore, expression of OsBURP-like polypeptides (at least in their native form) typically is induced by abiotic stress factors, such as drought. Tools and techniques for measuring abiotic stress, particularly drought tolerance, are well known in the art (see for example Ding et al., Planta 2009, Vol. 230, pages 149-163). Further details are provided in Example 6.

In addition, OsBURP-like polypeptides, when expressed in rice according to the methods of the present invention as outlined in Examples 7 and 8, give plants having increased yield related traits, in particular increased filling rate of seeds, and, thus, increased seed weight increased seed yield and increased harvest index.

Concerning AP2/ERF-like polypeptides, the polypeptide sequence which when used in the construction of a phylogenetic tree, such as the one depicted in FIG. 11, preferably clusters with the group of AP2/ERF polypeptides (eventually refer to a specific group defined in the literature) comprising the amino acid sequence represented by SEQ ID NO: 160 rather than with any other group.

Furthermore, AP2/ERF polypeptides (at least in their native form) typically have DNA-binding activity. Tools and techniques for measuring DNA-binding activity are well known in the art such as the ones described in Allen M D, et al. (EMBO J. 1998 Sep. 15; 17(18):5484-96).

In addition, AP2/ERF polypeptides, when expressed in rice according to the methods of the present invention as outlined in Examples 7 and 8, give plants having increased yield related traits, such as maximum height of a plant and, in particular total seed yield, fill rate, number of filled seeds and harvest index.

In addition, TPS-TPP polypeptides, when expressed in rice according to the methods of the present invention as outlined in the Examples section, give plants having increased yield related traits, in particular any one or more of increased number or size of floral meristems, increased number of florets, increased number of seeds.

Concerning CLC-like polypeptides, the present invention is illustrated by transforming plants with the nucleic acid sequence represented by SEQ ID NO: 1, encoding the polypeptide sequence of SEQ ID NO: 2. However, performance of the invention is not restricted to these sequences; the methods of the invention may advantageously be performed using any CLC-like-encoding nucleic acid or CLC-like polypeptide as defined herein.

Examples of nucleic acids encoding CLC-like polypeptides are given in Table A1 of the Examples section herein. Such nucleic acids are useful in performing the methods of the invention. The amino acid sequences given in Table A1 of the Examples section are example sequences of orthologues and paralogues of the CLC-like polypeptide represented by SEQ ID NO: 2, the terms "orthologues" and "paralogues" being as defined herein. Further orthologues and paralogues may readily be identified by performing a so-called reciprocal blast search as described in the definitions section; where the query sequence is SEQ ID NO: 1 or SEQ ID NO: 2, the second BLAST (back-BLAST) would be against rice sequences.

Concerning osBURP-like polypeptides, the present invention is illustrated by transforming plants with the nucleic acid sequence represented by SEQ ID NO: 94, encoding the polypeptide sequence of SEQ ID NO: 95. However, performance of the invention is not restricted to these sequences; the methods of the invention may advantageously be performed using any OsBURP-like-encoding nucleic acid or OsBURP-like polypeptide as defined herein.

Examples of nucleic acids encoding OsBURP-like polypeptides are given in Table A2 of the Examples section herein. Such nucleic acids are useful in performing the methods of the invention. The amino acid sequences given in Table A2 of the Examples section are example sequences of orthologues and paralogues of the OsBURP-like polypeptide represented by SEQ ID NO: 95, the terms "orthologues" and "paralogues" being as defined herein. Further orthologues and paralogues may readily be identified by performing a so-called reciprocal blast search as described in the definitions section; where the query sequence is SEQ ID NO: 94 or SEQ ID NO: 95, the second BLAST (back-BLAST) would be against rice sequences.

The present invention is illustrated by transforming plants with the nucleic acid sequence represented by SEQ ID NO: 159, encoding the polypeptide sequence of SEQ ID NO: 160. However, performance of the invention is not restricted to these sequences; the methods of the invention may advantageously be performed using any AP2/ERF-encoding nucleic acid or AP2/ERF polypeptide as defined herein.

Examples of nucleic acids encoding AP2/ERF polypeptides are given in Table A3 of the Examples section herein. Such nucleic acids are useful in performing the methods of the invention. The amino acid sequences given in Table A3 of the Examples section are example sequences of orthologues and paralogues of the AP2/ERF polypeptide represented by SEQ ID NO: 160, the terms "orthologues" and "paralogues" being as defined herein. Further orthologues and paralogues may readily be identified by performing a so-called reciprocal blast search as described in the definitions section; where the query sequence is SEQ ID NO: 159 or SEQ ID NO: 160, the second BLAST (back-BLAST) would be against rice sequences.

The present invention is illustrated by transforming plants with the nucleic acid sequence represented by SEQ ID NO: 440, 442 and 444 encoding the polypeptide sequence of SEQ ID NO: 441, 443 and 445 respectively. However, performance of the invention is not restricted to these sequences; the methods of the invention may advantageously be performed using any TPS-TPS-encoding nucleic acid or TPS-TPP polypeptide as defined herein.

Alternatively the methods of the invention maybe performed by simultaneously expressing or generating in a plant both enzymatic activities, a TPS and a TPP. Methods to simultaneously express both activities are well known in the art. For example the following nucleic acids may be modulated in a plant or in a plant cell: a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules. Modulation of such nucleic acids may be performed by introducing and expressing such one or more nucleic acids in a plant, preferably under the control of promoters having the same tissue distribution and similar strength, most preferably using the same promoter.

Accordingly, the present invention provides a method for enhancing yield-related traits comprising modulating expression in the plant of:
 (i) a nucleic acid encoding a TPS-TPP protein fusion; or
 (ii) a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules; or
 (iii) said one or more nucleic acids of (i) and (ii) further comprising a sequence encoding a chloroplast targeting signal.

The invention further provides plants obtainable with such method.

Preferably the polynucleotides useful in the methods of the invention are modulated in the chloroplast of a plant cell. Accordingly, the polypeptides useful in the methods of the invention preferably are targeted to the chloroplast. Chloroplast transit peptides useful to transport polypeptides into the chloroplast have been described (Table 3 and SEQ ID NOs: 470 to 491). Advantageously the polynucleotides of the invention may be introduced and expressed in the chloroplast for example by direct transformation of Chloroplast. Said methods are well known in the art.

TABLE 3

Chloroplastic transit peptides

| Description transit peptide | SEQ ID NO: |
|---|---|
| From *Arabidopsis thalana* P450 protein (AEB16913) | 470 |
| Transit peptide from *Arabidopsis* COS1 (COI1 suppressor 1) | 471 |
| Transit peptide From tomato rubisco small subunit (AAM50960) | 472 |
| Transit peptide corn SSU (AEE66528) | 473 |
| Transit peptide from corn AS1 | 474 |
| Transit peptide from corn AS2 | 475 |
| Transit peptide spinach (AAY97391) | 476 |
| Transint peptide *Ipomea batata* ADP-glucose phosphorylase | 477 |
| Transit peptide from rice SGR (stay green gene, Os09g0532000) | 478 |
| Transit peptide from soybean rubisco small subunit precursor (AAA82069) | 479 |
| Transit peptide from *Populus alba* isoprene synthase (ABV04402) | 480 |
| Modified transit peptide for chloroplast targeting (CAA48415) | 481 |
| Transit peptide from *Arabidopsis* RbcS-TP | 482 |
| Transit peptide from *Arabidopsis* E1alpha subunit of pyruvate dehydrogenase | 483 |
| Transit peptide from pea Carbonic anhydrase | 484 |
| Transit peptide from *Flaveria pringlei* CA3 | 485 |
| 88 aa non canonical TP from Pea | 486 |
| Transit peptide from *Arabiodpsis* BCCP | 487 |
| Transit peptide from *Arabiodpsis* GLU2 | 488 |
| Transit peptide from ATP synthase delta subunit protein of *Bigelowiella natans* (chlorarachniophyte algae) | 489 |
| Transit peptide from Fdx1 of *Bigelowiella natans* (chlorarachniophyte algae) | 490 |
| Transit peptide from RpL28 of *Bigelowiella natans* (chlorarachniophyte algae) | 491 |

Alternative methods to increase or generate TPS and TPP activity in a plant exist, for example by crossing plant having increased or generated individual TPS or TPP activity, for example using transgenic technology.

Methods for introducing and expressing two or more transgenes (also called gene stacking) in transgenic plants are well known in the art (see for example, a review by Halpin (2005) Plant Biotech J (3): 141-155. Gene stacking can proceed by interactive steps, where two or more transgenes can be sequentially introduced into a plant by crossing a plant containing one transgene with individuals harbouring other transgenes or, alternatively, by re-transforming (or super-transforming) a plant containing one transgene with new genes. The two or more transgenes maybe introduced simultaneously by transformation with for example a culture of mix Agroacterium tumefaciens strains harbouring each of the transgenes of to be introduced in the plant.

Examples of nucleic acids encoding TPS, TPP and TPS-TPP polypeptides are given in Tables A4 to A6 of the Examples section herein. Such nucleic acids are useful in performing the methods of the invention. The amino acid sequences given in Table A4 to A6 of the Examples section, are example sequences of orthologues and paralogues of the polypeptides used to transformed rice plants according to the Example section. Further orthologues and paralogues may readily be identified by performing a so-called reciprocal blast search as described in the definitions section.

The invention also provides hitherto unknown TPS-encoding and TPP-encoding nucleic acids and TPS and TPP polypeptides useful for conferring enhanced yield-related traits in plants relative to control plants.

According to a further embodiment of the present invention, there is therefore provided an isolated nucleic acid molecule selected from:

(i) a nucleic acid represented by any one of the sequences of Table A4 and Table A5;
(ii) the complement of a nucleic acid represented by any one of the sequences of Table A4 and Table A5;
(iii) a nucleic acid encoding a TPS or a TPP polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any of the polypeptides of Table A4 or Table A5 respectively and further preferably conferring enhanced yield-related traits relative to control plants.
(iv) a nucleic acid molecule which hybridizes with a nucleic acid molecule of (i) to (iii) under high stringency hybridization conditions and preferably confers enhanced yield-related traits relative to control plants.

According to a further embodiment of the present invention, there is also provided an isolated polypeptide selected from:

(i) an amino acid sequence represented by any one of the sequences of Tables A4 and A5;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of the sequences of Tables A4 and A5 and further preferably conferring enhanced yield-related traits relative to control plants;
(iii) derivatives of any of the amino acid sequences given in (i) or (ii) above.

Alternatively transgenes maybe stacked by sequential retransformation with each gene.

Nucleic acid variants may also be useful in practicing the methods of the invention. Examples of such variants include nucleic acids encoding homologues and derivatives of any one of the amino acid sequences given in Table A1 to A6 of the Examples section, the terms "homologue" and "derivative" being as defined herein. Also useful in the methods of the invention are nucleic acids encoding homologues and derivatives of orthologues or paralogues of any one of the amino acid sequences given in Table A1 to A6 of the Examples section. Homologues and derivatives useful in the methods of the present invention have substantially the same biological and functional activity as the unmodified protein from which they are derived. Further variants useful in practicing the methods of the invention are variants in which codon usage is optimised or in which miRNA target sites are removed.

Further nucleic acid variants useful in practicing the methods of the invention include portions of nucleic acids encoding CLC-like polypeptides, or OsBURP-like polypeptides, or AP2/ERF polypeptides, or TPS, TPP and TPS-TPP polypeptides, nucleic acids hybridising to nucleic acids encoding CLC-like polypeptides, or OsBURP-like polypeptides, or AP2/ERF polypeptides, or TPS, TPP and TPS-TPP polypeptides, splice variants of nucleic acids encoding CLC-like polypeptides, or OsBURP-like polypeptides, or AP2/ERF polypeptides, or TPS, TPP and TPS-TPP polypeptides, allelic variants of nucleic acids encoding CLC-like polypeptides, or OsBURP-like polypeptides, or AP2/ERF polypeptides, or TPS, TPP and TPS-TPP polypeptides, and variants of nucleic acids encoding CLC-like polypeptides, or OsBURP-like polypeptides, or AP2/ERF polypeptides, or TPS, TPP and TPS-TPP polypeptides obtained by gene shuffling. The terms hybridising sequence, splice variant, allelic variant and gene shuffling are as described herein.

Nucleic acids encoding CLC-like polypeptides, or OsBURP-like polypeptides, or AP2/ERF polypeptides, or TPS, TPP and TPS-TPP polypeptides, need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A1 to A6 of the Examples section, or a portion of a nucleic acid encoding an orthologue, paralogue or homologue of any of the amino acid sequences given in Table A1 to A6 of the Examples section.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Concerning CLC-like polypeptides, portions useful in the methods of the invention, encode a CLC-like polypeptide as defined herein, and have substantially the same biological activity as the amino acid sequences given in Table A1 of the Examples section. Preferably, the portion is a portion of any one of the nucleic acids given in Table A1 of the Examples section, or is a portion of a nucleic acid encoding an orthologue or paralogue of any one of the amino acid sequences given in Table A1 of the Examples section. Preferably the portion is at least 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2150, 2200, 2250, 2300, 2350, 2400 consecutive nucleotides in length, the consecutive nucleotides being of any one of the nucleic acid sequences given in Table A1 of the Examples section, or of a nucleic acid encoding an orthologue or paralogue of any one of the amino acid sequences given in Table A1 of the Examples section. Most preferably the portion is a portion of the nucleic acid of SEQ ID NO: 1. Preferably, the portion encodes a fragment of an amino acid sequence which, when used in the construction of a phylogenetic tree, such as the one depicted in FIG. 3, clusters with the group of CLC-like polypeptides comprising the amino acid sequence represented by SEQ ID NO: 2 rather than with any other anion channel proteins like Aluminium Tolerance (ALMT) Anion Channels or Slow Anion Channels (SLAC), or with the glutamate receptor homologue family (Ward et al, Annu. Rev. Physiol. 71, 59-82, 2009; Brenner et al, Plant Physiol. 124, 1615-1624, 2000) and/or comprises one or more of the motifs 1 to 8.

Concerning osBURP-like polypeptides, portions useful in the methods of the invention, encode an OsBURP-like polypeptide as defined herein, and have substantially the same biological activity as the amino acid sequences given in Table A2 of the Examples section. Preferably, the portion is a portion of any one of the nucleic acids given in Table A2 of the Examples section, or is a portion of a nucleic acid encoding an orthologue or paralogue of any one of the amino acid sequences given in Table A2 of the Examples section. Preferably the portion is at least 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2150, 2200, 2250, 2300 consecutive nucleotides in length, the consecutive nucleotides being of any one of the nucleic acid sequences given in Table A2 of the Examples section, or of a nucleic acid encoding an orthologue or paralogue of any one of the amino acid sequences given in Table A2 of the Examples section. Most preferably the portion is a portion of the nucleic acid of SEQ ID NO: 94. Preferably, the portion encodes a fragment of an amino acid sequence which, when used in the construction of a phylogenetic tree, such as the one depicted in FIG. 7, clusters with the group of OsBURP-like polypeptides belonging to BURP V clade as defined by Ding et al., 2009, comprising the amino acid sequence represented by SEQ ID NO: 95 rather than with any other group, and/or comprises anyone of more of the motifs represented by SEQ ID NO: 140 to 155.

Concerning AP2/ERF-like polypeptides, portions useful in the methods of the invention, encode an AP2/ERF polypeptide as defined herein, and have substantially the same biological activity as the amino acid sequences given in Table A3 of the Examples section. Preferably, the portion is a portion of any one of the nucleic acids given in Table A3 of the Examples section, or is a portion of a nucleic acid encoding an orthologue or paralogue of any one of the amino acid sequences given in Table A3 of the Examples section. Preferably the portion is at least 500, 550, 600, 650, 700, 750, 800, 850, 900, 950, 1000 consecutive nucleotides in length, the consecutive nucleotides being of any one of the nucleic acid sequences given in Table A3 of the Examples section, or of a nucleic acid encoding an orthologue or paralogue of any one of the amino acid sequences given in Table A3 of the Examples section. Most preferably the portion is a portion of the nucleic acid of SEQ ID NO: 159. Preferably, the portion encodes a fragment of an amino acid sequence which, when used in the construction of a phylogenetic tree, such as the one depicted in FIG. 11, clusters with the group of AP2/ERF polypeptides comprising the amino acid sequence represented by SEQ ID NO: 160 rather than with any other group AND/OR: comprises motifs 25 to 28 AND/OR has DNA-binding activity AND/OR: has at least 49% sequence identity to SEQ ID NO: 160.

Concerning TPS-TPP-like polypeptides, portions useful in the methods of the invention, encode a TPS, TPP and TPS-TPP polypeptide as defined herein, and have substantially the same biological activity as the amino acid sequences given in Table A4 to A6 of the Examples section. Preferably, the portion is a portion of any one of the nucleic acids given in Table A4 to A6 of the Examples section, or is a portion of a nucleic acid encoding an orthologue or paralogue of any one of the amino acid sequences given in Table A4 to A6 of the Examples section. Preferably the portion is at least 100, 200, 300, 400, 500, 550, 600, 650, 700, 750, 800, 850, 900, 950, 1000 consecutive nucleotides in length, the consecutive nucleotides being of any one of the nucleic acid sequences given in Table A4 to A6 of the Examples section, or of a nucleic acid encoding an orthologue or paralogue of any one of the amino acid sequences given in Table A4 to A6 of the Examples section. Most preferably the portion is a portion of the nucleic acid of SEQ ID NO: 272. Preferably, the portion encodes a fragment of an amino acid sequence comprising the pfam domains according to the definition section herein Another nucleic acid variant useful in the methods of the invention is a nucleic acid capable of hybridising, under reduced stringency conditions, preferably under stringent conditions, with a nucleic acid encoding a CLC-like polypeptide, or an OsBURP-like polypeptide, or an AP2/ERF polypeptide, or a TPS, TPP and TPS-TPP polypeptide as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table A1 to A6 of the Examples section, or comprising introducing and expressing in a plant a nucleic acid capable of hybridising to a nucleic acid encoding an orthologue, paralogue or homologue of any of the nucleic acid sequences given in Table A1 to A6 of the Examples section.

Concerning CLC-like polypeptides, hybridising sequences useful in the methods of the invention encode a CLC-like polypeptide as defined herein, having substantially the same biological activity as the amino acid sequences given in Table A1 of the Examples section. Preferably, the hybridising sequence is capable of hybridising to the complement of any one of the nucleic acids given in Table A1 of the Examples section, or to a portion of any of these sequences, a portion being as defined above, or the hybridising sequence is capable of hybridising to the complement of a nucleic acid encoding an orthologue or paralogue of any one of the amino acid sequences given in Table A1 of the Examples section. Most preferably, the hybridising sequence is capable of hybridising to the complement of a nucleic acid as represented by SEQ ID NO: 1 or to a portion thereof.

Preferably, the hybridising sequence encodes a polypeptide with an amino acid sequence which, when full-length and used in the construction of a phylogenetic tree, such as the one depicted in FIG. 3, clusters with the group of CLC-like polypeptides comprising the amino acid sequence represented by SEQ ID NO: 2 rather than with any other anion channel proteins like Aluminium Tolerance (ALMT) Anion Channels or Slow Anion Channels (SLAC), or with the glutamate receptor homologue family (Ward et al, Annu. Rev. Physiol. 71, 59-82, 2009; Brenner et al, Plant Physiol. 124, 1615-1624, 2000) and/or comprises one or more of the motifs 1 to 8.

Concerning osBURP-like polypeptides, hybridising sequences useful in the methods of the invention encode an OsBURP-like polypeptide as defined herein, having substantially the same biological activity as the amino acid sequences given in Table A2 of the Examples section. Preferably, the hybridising sequence is capable of hybridising to the complement of any one of the nucleic acids given in Table A2 of the Examples section, or to a portion of any of these sequences, a portion being as defined above, or the hybridising sequence is capable of hybridising to the complement of a nucleic acid encoding an orthologue or paralogue of any one of the amino acid sequences given in Table A2 of the Examples section. Most preferably, the hybridising sequence is capable of hybridising to the complement of a nucleic acid as represented by SEQ ID NO: 94 or to a portion thereof.

Preferably, the hybridising sequence encodes a polypeptide with an amino acid sequence which, when full-length and used in the construction of a phylogenetic tree, such as the one depicted in FIG. 7, clusters with the group of OsBURP-like polypeptides belonging to BURP V clade as defined by Ding et al., 2009, comprising the amino acid sequence represented by SEQ ID NO: 95 rather than with any other group and/or comprises anyone or more of the motifs represented by SEQ ID NO: 140 to 155.

Concerning AP2/ERF-like polypeptides, hybridising sequences useful in the methods of the invention encode an AP2/ERF polypeptide as defined herein, having substantially the same biological activity as the amino acid sequences given in Table A3 of the Examples section. Preferably, the hybridising sequence is capable of hybridising to the complement of any one of the nucleic acids given in Table A3 of the Examples section, or to a portion of any of these sequences, a portion being as defined above, or the hybridising sequence is capable of hybridising to the complement of a nucleic acid encoding an orthologue or paralogue of any one of the amino acid sequences given in Table A3 of the Examples section. Most preferably, the hybridising sequence is capable of hybridising to the complement of a nucleic acid as represented by SEQ ID NO: 159 or to a portion thereof.

Preferably, the hybridising sequence encodes a polypeptide with an amino acid sequence which, when full-length and used in the construction of a phylogenetic tree, such as the one depicted in FIG. 11, clusters with the group of AP2/ERF polypeptides comprising the amino acid sequence represented by SEQ ID NO: 160 rather than with any other group group AND/OR: comprises motifs 25 to 28 AND/OR has DNA-binding activity AND/OR: has at least 49% sequence identity to SEQ ID NO: 160.

Hybridising sequences useful in the methods of the invention encode a TPS, TPP and TPS-TPP polypeptide as defined herein, having substantially the same biological activity as the amino acid sequences given in Table A4 to A6 of the Examples section. Preferably, the hybridising sequence is capable of hybridising to the complement of any one of the nucleic acids given in Table A4 to A6 of the Examples section, or to a portion of any of these sequences, a portion being as defined above, or the hybridising sequence is capable of hybridising to the complement of a nucleic acid encoding an orthologue or paralogue of any one of the amino acid sequences given in Table A4 to A6 of the Examples section. Most preferably, the hybridising sequence is capable of hybridising to the complement of a nucleic acid as represented by SEQ ID NO: 272, or SEQ ID NO: 440 or SEQ ID NO: 442 or to a portion thereof.

Preferably, the hybridising sequence encodes a polypeptide with an amino acid sequence comprising the pfam domains according to the definition section herein.

Another nucleic acid variant useful in the methods of the invention is a splice variant encoding a CLC-like polypeptide, or an OsBURP-like polypeptide, or an AP2/ERF polypeptide, or a TPS, TPP and TPS-TPP, as defined hereinabove, a splice variant being as defined herein.

According to the present invention, there is provided a method for enhancing yield-related traits in plants, comprising introducing and expressing in a plant a splice variant of any one of the nucleic acid sequences given in Table A1 to A6 of the Examples section, or a splice variant of a nucleic acid encoding an orthologue, paralogue or homologue of any of the amino acid sequences given in Table A1 to A6 of the Examples section.

Concerning CLC-like polypeptides, preferred splice variants are splice variants of a nucleic acid represented by SEQ ID NO: 1, or a splice variant of a nucleic acid encoding an orthologue or paralogue of SEQ ID NO: 2. Preferably, the amino acid sequence encoded by the splice variant, when used in the construction of a phylogenetic tree, such as the one depicted in FIG. 3, clusters with the group of CLC-like polypeptides comprising the amino acid sequence represented by SEQ ID NO: 2 rather than with any other anion channel proteins like Aluminium Tolerance (ALMT) Anion Channels or Slow Anion Channels (SLAC), or with the glutamate receptor homologue family (Ward et al, Annu. Rev. Physiol. 71, 59-82, 2009; Brenner et al, Plant Physiol. 124, 1615-1624, 2000) and/or comprises one or more of the motifs 1 to 8.

Concerning osBURP-like polypeptides, preferred splice variants are splice variants of a nucleic acid represented by SEQ ID NO: 94, or a splice variant of a nucleic acid encoding an orthologue or paralogue of SEQ ID NO: 95. Preferably, the amino acid sequence encoded by the splice variant, when used in the construction of a phylogenetic tree, such as the one depicted FIG. 7, clusters with the group of OsBURP-like polypeptides belonging to BURP V clade as defined by Ding et al., 2009, comprising the amino acid sequence represented by SEQ ID NO: 95 rather than with any other group and/or comprises anyone or more of the motifs represented by SEQ ID NO: 140 to 155.

Concerning AP2/ERF-like polypeptides, preferred splice variants are splice variants of a nucleic acid represented by SEQ ID NO: 159, or a splice variant of a nucleic acid encoding an orthologue or paralogue of SEQ ID NO: 160. Preferably, the amino acid sequence encoded by the splice variant, when used in the construction of a phylogenetic tree, such as the one depicted in FIG. 11, clusters with the group of AP2/ERF polypeptides comprising the amino acid sequence represented by SEQ ID NO: 160 rather than with any other group AND/OR: comprises motifs 25 to 28 AND/OR has DNA-binding activity AND/OR: has at least 49% sequence identity to SEQ ID NO: 160.

Concerning TPS-TPP-like polypeptides, preferred splice variants are splice variants of a nucleic acid represented by the nucleic acids used to transform rice plants according to the methods of the invention, or a splice variant of a nucleic acid encoding an orthologue or paralogue of the respective encoded polypeptides. Preferably, the amino acid sequence encoded by the splice variant, comprise the pfam domains according to the definition section herein.

Another nucleic acid variant useful in performing the methods of the invention is an allelic variant of a nucleic acid encoding a CLC-like polypeptide, or an OsBURP-like polypeptide, or an AP2/ERF polypeptide, or a TPS, TPP and TPS-TPP, as defined hereinabove, an allelic variant being as defined herein.

According to the present invention, there is provided a method for enhancing yield-related traits in plants, comprising introducing and expressing in a plant an allelic variant of any one of the nucleic acids given in Table A1 to A6 of the Examples section, or comprising introducing and expressing in a plant an allelic variant of a nucleic acid encoding an orthologue, paralogue or homologue of any of the amino acid sequences given in Table A1 to A6 of the Examples section.

Concerning CLC-like polypeptides, the polypeptides encoded by allelic variants useful in the methods of the present invention have substantially the same biological activity as the CLC-like polypeptide of SEQ ID NO: 2 and any of the amino acids depicted in Table A1 of the Examples section. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2. Preferably, the amino acid sequence encoded by the allelic variant, when used in the construction of a phylogenetic tree, such as the one depicted in FIG. 3, clusters with the group of CLC-like polypeptides comprising the amino acid sequence represented by SEQ ID NO: 2 rather than with any other anion channel proteins like Aluminium Tolerance (ALMT) Anion Channels or Slow Anion Channels (SLAC), or with the glutamate receptor homologue family (Ward et al, Annu. Rev. Physiol. 71, 59-82, 2009; Brenner et al, Plant Physiol. 124, 1615-1624, 2000) and/or comprises one or more of the motifs 1 to 8.

Concerning osBURP-like polypeptides, the polypeptides encoded by allelic variants useful in the methods of the present invention have substantially the same biological activity as the OsBURP-like polypeptide of SEQ ID NO: 95 and any of the amino acids depicted in Table A2 of the Examples section. Allelic variants exist in nature, and encompassed within the methods of the present invention is the use of these natural alleles. Preferably, the allelic variant is an allelic variant of SEQ ID NO: 94 or an allelic variant of a nucleic acid encoding an orthologue or paralogue of SEQ ID NO: 95. Preferably, the amino acid sequence encoded by the allelic variant, when used in the construction of a phylogenetic tree, such as the one depicted in FIG. 7, clusters with the group of OsBURP-like polypeptides belonging to BURP V clade as defined by Ding et al., 2009, comprising the amino acid sequence represented by SEQ ID NO: 95 rather than with any other group and/or comprises anyone or more of the motifs represented by SEQ ID NO: 140 to 155.

Concerning AP2/ERF-like polypeptides, the polypeptides encoded by allelic variants useful in the methods of the present invention have substantially the same biological activity as the AP2/ERF polypeptide of SEQ ID NO: 160 and any of the amino acids depicted in Table A3 of the Examples section. Allelic variants exist in nature, and encompassed within the methods of the present invention is the use of these natural alleles. Preferably, the allelic variant is an allelic variant of SEQ ID NO: 159 or an allelic variant of a nucleic acid encoding an orthologue or paralogue of SEQ ID NO: 160. Preferably, the amino acid sequence encoded by the allelic variant, when used in the construction of a phylogenetic tree, such as the one depicted in FIG. 11, clusters with the AP2/ERF polypeptides comprising the amino acid sequence represented by SEQ ID NO: 160 rather than with any other group AND/OR: comprises motifs 25 to 28 AND/OR has DNA-binding activity AND/OR: has at least 49% sequence identity to SEQ ID NO: 160.

Concerning TPS-TPP-like polypeptides, the polypeptides encoded by allelic variants useful in the methods of the present invention have substantially the same biological activity as the TPS, TPP and TPS-TPP polypeptide as used to transformed rice plants in the Examples herein and any of the amino acids depicted in Table A4 to A6 of the Examples section. Allelic variants exist in nature, and encompassed within the methods of the present invention is the use of these natural alleles. Preferably, the allelic variant is an allelic variant useful in the invention comprise the pfam domains according to the definition section herein.

Gene shuffling or directed evolution may also be used to generate variants of nucleic acids encoding CLC-like polypeptides, or OsBURP-like polypeptides, or AP2/ERF polypeptides, or TPS, TPP and TPS-TPP polypeptides, as defined above; the term "gene shuffling" being as defined herein.

According to the present invention, there is provided a method for enhancing yield-related traits in plants, comprising introducing and expressing in a plant a variant of any one of the nucleic acid sequences given in Table A1 to A6 of the Examples section, or comprising introducing and expressing in a plant a variant of a nucleic acid encoding an orthologue, paralogue or homologue of any of the amino acid sequences given in Table A1 to A6 of the Examples section, which variant nucleic acid is obtained by gene shuffling.

Concerning CLC-like polypeptides, the amino acid sequence encoded by the variant nucleic acid obtained by gene shuffling, when used in the construction of a phylogenetic tree such as the one depicted in FIG. 3, preferably clusters with the group of CLC-like polypeptides comprising the amino acid sequence represented by SEQ ID NO: 2 rather than with any other anion channel proteins like Aluminium Tolerance (ALMT) Anion Channels or Slow Anion Channels (SLAC), or with the glutamate receptor homologue family (Ward et al, Annu. Rev. Physiol. 71, 59-82, 2009; Brenner et al, Plant Physiol. 124, 1615-1624, 2000) and/or comprises one or more of the motifs 1 to 8.

Concerning osBURP-like polypeptides, the amino acid sequence encoded by the variant nucleic acid obtained by gene shuffling, when used in the construction of a phylogenetic tree such as the one depicted in FIG. 7, preferably clusters with the group of OsBURP-like polypeptides belonging to BURP V clade as defined by Ding et al., 2009, comprising the amino acid sequence represented by SEQ ID NO: 95 rather than with any other group and/or comprises anyone or more of the motifs represented by SEQ ID NO: 140 to 155.

Concerning AP2/ERF-like polypeptides, the amino acid sequence encoded by the variant nucleic acid obtained by gene shuffling, when used in the construction of a phylogenetic tree such as the one depicted in FIG. 11, preferably clusters with the group of AP2/ERF polypeptides comprising the amino acid sequence represented by SEQ ID NO: 160 rather than with any other group AND/OR: comprises motifs 25 to 28 AND/OR has DNA-binding activity AND/OR: has at least 49% sequence identity to SEQ ID NO: 160.

Concerning TPS-TPP-like polypeptides, the amino acid sequence encoded by the variant nucleic acid obtained by gene shuffling, preferably comprise the pfam domains according to the definition section herein.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Concerning CLC-like polypeptides, nucleic acids encoding CLC-like polypeptides may be derived from any natural or artificial source. The nucleic acid may be modified from its native form in composition and/or genomic environment through deliberate human manipulation. Preferably the CLC-like polypeptide-encoding nucleic acid is from a plant, further preferably from a monocotyledonous plant, more preferably from the family Poaceae, most preferably the nucleic acid is from *Oryza sativa*.

Concerning osBURP-like polypeptides, nucleic acids encoding OsBURP-like polypeptides may be derived from any natural or artificial source. The nucleic acid may be modified from its native form in composition and/or genomic environment through deliberate human manipulation. Preferably the OsBURP-like polypeptide-encoding nucleic acid is from a plant, further preferably from a monocotyledonous plant, more preferably from the family Poaceae, most preferably the nucleic acid is from *Oryza sativa*.

Concerning AP2/ERF-like polypeptides, nucleic acids encoding AP2/ERF polypeptides may be derived from any natural or artificial source. The nucleic acid may be modified from its native form in composition and/or genomic environment through deliberate human manipulation. Preferably the AP2/ERF polypeptide-encoding nucleic acid is from a plant, further preferably from a dicotyledonous plant, more preferably from the family Fabaceae, most preferably the nucleic acid is from *Medicago truncatula*.

Concerning TPS-TPP-like polypeptides, nucleic acids encoding TPS, TPP, TPS-TPP polypeptides may be derived from any natural or artificial source. The nucleic acid may be modified from its native form in composition and/or genomic environment through deliberate human manipulation. Preferably the PTPS, TPP, TPS-TPP polypeptide-encoding nucleic acid is from a plant, further preferably from a monocotyledonous plant, more preferably from the family Brassicaceae, most preferably the nucleic acid is from *Arabidopsis thaliana* or from the yeast *Saccharomyces cerevisie*.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Concerning CLC-like polypeptides, or OsBURP-like polypeptides, or AP2/ERF polypeptides, reference herein to enhanced yield-related traits is taken to mean an increase early vigour and/or in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

Concerning TPS-TPP-like polypeptides, reference herein to enhanced yield-related traits is taken to mean an increase early vigour and/or in biomass (weight) of one or more parts of a plant, which may include aboveground (harvestable) parts and/or (harvestable) parts below ground. Furthermore it is taken to mean any one or more of increased size or number of floral meristems, increased number of flowers, increased number of seeds, increased yield, preferably increased biomass and/or increased seed weight relative to control plants. In particular, such harvestable parts are seeds, and performance of the methods of the invention results in plants having increased seed yield relative to the seed yield of control plants.

The present invention provides a method for increasing yield-related traits, especially seed yield of plants, relative to control plants, which method comprises modulating expression in a plant of a nucleic acid encoding a CLC-like polypeptide, or an OsBURP-like polypeptide, or an AP2/ERF polypeptide, as defined herein.

Concerning TPS-TPP-like polypeptides, the present invention provides a method for enhancing or increasing (yield-related traits—yield), especially size and/or number of floral meristems, number of flowers and/or florets, number of seeds, seed yield and biomass of plants, relative to control plants, which method comprises modulating expression in a plant of a nucleic acid encoding a TPS, TPP or TPS-TPP polypeptide as defined herein.

Since the transgenic plants according to the present invention have increased yield related traits, it is likely that these plants exhibit an increased growth rate (during at least part of their life cycle), relative to the growth rate of control plants at a corresponding stage in their life cycle.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding a CLC-like polypeptide, or an OsBURP-like polypeptide, or an AP2/ERF polypeptide, or a TPS, TPP and TPS-TPP polypeptide as defined herein.

Concerning CLC-like polypeptides, performance of the methods of the invention gives plants grown under non-stress conditions or under drought conditions increased yield relative to control plants grown under comparable conditions. Therefore, according to the present invention, there is provided a method for increasing yield in plants grown under non-stress conditions or under drought conditions, which method comprises modulating expression in a plant of a nucleic acid encoding a CLC-like polypeptide.

Concerning OsBURP-like polypeptides, or AP2/ERF polypeptides, or a TPS, TPP and TPS-TPP polypeptides performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding an OsBURP-like polypeptide, or an AP2/ERF polypeptide, or a TPS, TPP and TPS-TPP polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a CLC-like polypeptide, or an OsBURP-like polypeptide, or an AP2/ERF polypeptide, or a TPS, TPP and TPS-TPP polypeptide.

Performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding a CLC-like polypeptide, or an OsBURP-like polypeptide, or an AP2/ERF polypeptide, or an TPS, TPP and TPS-TPP polypeptide.

The invention also provides genetic constructs and vectors to facilitate introduction and/or expression in plants of nucleic acids encoding CLC-like polypeptides, or OsBURP-like polypeptides, or AP2/ERF polypeptides, or TPS, TPP and TPS-TPP polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding a CLC-like polypeptide, or an OsBURP-like polypeptide, or an AP2/ERF polypeptide, or a TPS, TPP and TPS-TPP polypeptide as defined above;
(b) one or more control sequences capable of driving expression of the nucleic acid sequence of (a); and optionally
(c) a transcription termination sequence.

Preferably, the nucleic acid encoding a CLC-like polypeptide, or an OsBURP-like polypeptide, or an AP2/ERF polypeptide, or a TPS, TPP and TPS-TPP polypeptide is as defined above. The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Concerning CLC-like polypeptides, or OsBURP-like polypeptides, or AP2/ERF polypeptides, advantageously, any type of promoter, whether natural or synthetic, may be used to drive expression of the nucleic acid sequence, but preferably the promoter is of plant origin. A constitutive promoter is particularly useful in the methods. Preferably the constitutive promoter is a ubiquitous constitutive promoter of medium strength. See the "Definitions" section herein for definitions of the various promoter types.

Concerning advantageously, any type of promoter, whether natural or synthetic, may be used to drive expression of the nucleic acid sequence, but preferably the promoter is of plant origin. A constitutive promoter is particularly useful in the methods. Preferably the constitutive promoter is a ubiquitous constitutive promoter of medium strength. See the "Definitions" section herein for definitions of the various promoter types. Also useful in the methods of the invention is a flower or a meristem specific promoter.

Concerning CLC-like polypeptides, it should be clear that the applicability of the present invention is not restricted to the CLC-like polypeptide-encoding nucleic acid represented by SEQ ID NO: 1, nor is the applicability of the invention restricted to expression of a CLC-like polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 91, most preferably the constitutive promoter is as represented by SEQ ID NO: 91. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 91, and the nucleic acid encoding the CLC-like polypeptide.

Concerning osBURP-like polypeptides, it should be clear that the applicability of the present invention is not restricted to the OsBURP-like polypeptide-encoding nucleic acid represented by SEQ ID NO: 94, nor is the applicability of the invention restricted to expression of an OsBURP-like polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 156, most preferably the constitutive promoter is as represented by SEQ ID NO: 156. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 156, and the nucleic acid encoding the OsBURP-like polypeptide. Furthermore, one or more sequences encoding selectable markers may be present on the construct introduced into a plant.

Concerning AP2/ERf polypeptides, it should be clear that the applicability of the present invention is not restricted to the AP2/ERF polypeptide-encoding nucleic acid represented by SEQ ID NO: 159, nor is the applicability of the invention restricted to expression of a AP2/ERF polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 269, most preferably the constitutive promoter is as represented by SEQ ID NO: 269. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 269, and the nucleic acid encoding the AP2/ERF polypeptide.

Concerning TPS-TPP-like polypeptides, it should be clear that the applicability of the present invention is not restricted to the TPS, TPP, and TPS-TPP polypeptide-encoding nucleic acid represented by the sequences used to transformed rice according to the Examples section, nor is the applicability of the invention restricted to expression of a TPS, TPP, and TPS-TPP polypeptide-encoding nucleic acid when driven by a constitutive promoter, or when driven by a flower or a meristem specific promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 457, most preferably the constitutive promoter is as represented by SEQ ID NO: 457. See the "Definitions" section herein for further examples of constitutive promoters.

Examples of flower and meristem promoters are given in table 2 of the definitions section.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding a CLC-like polypeptide, or an OsBURP-like polypeptide, or an AP2/ERF polypeptide, or a TPS, TPP and TPS-TPP polypeptide is by introducing and expressing in a plant a nucleic acid encoding a CLC-like polypeptide, or an OsBURP-like polypeptide, or an AP2/ERF polypeptide, or a TPS, TPP and TPS-TPP polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The invention also provides a method for the production of transgenic plants having enhanced yield-related traits relative to control plants, comprising introduction and expression in a plant of any nucleic acid encoding a CLC-like polypeptide, or an OsBURP-like polypeptide, or an AP2/ERF polypeptide, or a TPS, TPP and TPS-TPP polypeptide as defined hereinabove.

Concerning CLC-like polypeptides, or OsBURP-like polypeptides, or AP2/ERF polypeptides, the present invention, more specifically provides a method for the production of transgenic plants having enhanced yield-related traits, particularly increased (seed) yield, which method comprises:
 (i) introducing and expressing in a plant or plant cell respectively a CLC-like polypeptide, or an OsBURP-like polypeptide, or an AP2/ERF polypeptide—encoding nucleic acid; and
 (ii) cultivating the plant cell under conditions promoting plant growth and development.

The nucleic acid of (i) may be any of the nucleic acids capable of encoding a CLC-like polypeptide, or a OsBURP-like polypeptide, or a AP2/ERF polypeptide as defined herein.

Concerning TPS-TPP-like polypeptides, more specifically, the present invention provides a method for the production of transgenic plants having enhanced yield-related traits, particularly having any one or more of increased size or number of floral meristems, increased number of flowers, increased number of seeds, increased yield, preferably increased biomass and/or increased seed weight relative to control plants, which method comprises:
 (i) a nucleic acid encoding a TPS-TPP protein fusion; or
 (ii) a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules; or
 (iii) said one or more nucleic acids of (i) and (ii) further comprising a sequence encoding a chloroplast targeting signal; and
 (iv) cultivating the plant cell under conditions promoting plant growth and development.

The nucleic acid of (i) to (iii) may be any of the nucleic acids capable of encoding a TPS, TPP or a TPS-TPP polypeptide as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The present invention clearly extends to any plant cell or plant produced by any of the methods described herein, and to all plant parts and propagules thereof. The present invention encompasses plants or parts thereof (including seeds) obtainable by the methods according to the present invention. The plants or parts thereof comprise a nucleic acid transgene encoding a CLC-like polypeptide, or an OsBURP-like polypeptide, or an AP2/ERF polypeptide, or a TPS, TPP and TPS-TPP polypeptide, as defined above. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a CLC-like polypeptide, or an OsBURP-like polypeptide, or an AP2/ERF polypeptide, or a TPS, TPP and TPS-TPP polypeptide as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, sorghum, emmer, spelt, secale, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding a CLC-like polypeptide, or an OsBURP-like polypeptide, or an AP2/ERF polypeptide, or a TPS, TPP and TPS-TPP polypeptide. The invention furthermore relates to products derived, preferably directly derived, from a harvestable part of such a plant, such as dry pellets or powders, oil, fat and fatty acids, starch or proteins.

The present invention also encompasses use of nucleic acids encoding CLC-like polypeptides or OsBURP-like polypeptides, or AP2/ERF polypeptides, or TPS, TPP or TPS-TPP polypeptides, as described herein and use of these CLC-like polypeptides, or OsBURP-like polypeptides, or AP2/ERF polypeptides, or TPS, TPP or TPS-TPP polypeptides, in enhancing any of the aforementioned yield-related traits in plants. For example, nucleic acids encoding CLC-like polypeptides, or OsBURP-like polypeptides, or AP2/ERF polypeptides, or TPS, TPP and TPS-TPP polypeptides, described herein, or the CLC-like polypeptides, or OsBURP-like polypeptides, or AP2/ERF polypeptides, or TPS, TPP and TPS-TPP polypeptides, themselves, may find use in breeding programmes in which a DNA marker is identified which may be genetically linked to a CLC-like polypeptide, or an OsBURP-like polypeptide, or an AP2/ERF polypeptide, or a TPS, TPP and TPS-TPP polypeptide-encoding gene. The nucleic acids/genes, or the CLC-like polypeptides, or OsBURP-like polypeptides, or AP2/ERF polypeptides, or TPS, TPP and TPS-TPP polypeptides, themselves may be used to define a molecular marker. This DNA or protein marker may then be used in breeding programmes to select plants having enhanced yield-related traits as defined hereinabove in the methods of the invention. Furthermore, allelic variants of a CLC-like polypeptide, or an OsBURP-like polypeptide, or an AP2/ERF polypeptide, or a TPS, TPP and TPS-TPP polypeptide-encoding nucleic acid/gene may find use in marker-assisted breeding programmes. Nucleic acids encoding CLC-like polypeptides, or OsBURP-like polypeptides, or AP2/ERF polypeptides, or TPS, TPP and TPS-TPP polypeptides, may also be used as probes for genetically and physically mapping the genes that they are a part of, and as markers for traits linked to those genes. Such information may be useful in plant breeding in order to develop lines with desired phenotypes.

Items

The invention is characterised by one or more of the following items.

CLC-Like Polypeptide

1. A method for enhancing yield-related traits in plants relative to control plants, comprising modulating expression in a plant of a nucleic acid encoding a CLC-like polypeptide, wherein said CLC-like polypeptide comprises a Voltage_CLC domain (Pfam entry PF00654) and C-terminally thereof a CBS domain (Pfam entry PF00571).

2. Method according to item 1, wherein said CLC-like polypeptide comprises one or more of the motifs 1 to 8 (SEQ ID NO: 83 to SEQ ID NO: 90) or one or more of the motifs as represented by SEQ IN NO: 492 to SEQ ID NO: 503.

3. Method according to item 1 or 2, wherein said modulated expression is effected by introducing and expressing in a plant a nucleic acid encoding a CLC-like polypeptide.

4. Method according to any one of items 1 to 3, wherein said nucleic acid encoding a CLC-like polypeptide encodes any one of the proteins listed in Table A1 or is a portion of such a nucleic acid, or a nucleic acid capable of hybridising with such a nucleic acid.

5. Method according to any one of items 1 to 4, wherein said nucleic acid sequence encodes an orthologue or paralogue of any of the proteins given in Table A1.

6. Method according to any preceding items 1 to 5, wherein said enhanced yield-related traits comprise increased yield, preferably increased biomass and/or increased seed yield relative to control plants.

7. Method according to any one of items 1 to 6, wherein said enhanced yield-related traits are obtained under conditions of drought stress, or salt stress.

8. Method according to any one of items 3 to 7, wherein said nucleic acid is operably linked to a constitutive promoter, preferably to a GOS2 promoter, most preferably to a GOS2 promoter from rice.

9. Method according to any one of items 1 to 8, wherein said nucleic acid encoding a CLC-like polypeptide is of plant origin, preferably from a dicotyledonous plant, further preferably from the family Poaceae, more preferably from the genus *Oryza*, most preferably from *Oryza sativa*.

10. Plant or part thereof, including seeds, obtainable by a method according to any one of items 1 to 9, wherein said plant or part thereof comprises a recombinant nucleic acid encoding a CLC-like polypeptide.

11. Construct comprising:
   (i) nucleic acid encoding a CLC-like polypeptide as defined in items 1 or 2;
   (ii) one or more control sequences capable of driving expression of the nucleic acid sequence of (i); and optionally
   (iii) a transcription termination sequence.

12. Construct according to item 11, wherein one of said control sequences is a constitutive promoter, preferably a GOS2 promoter, most preferably a GOS2 promoter from rice.
13. Use of a construct according to item 11 or 12 in a method for making plants having increased yield, particularly increased biomass and/or increased seed yield relative to control plants.
14. Plant, plant part or plant cell transformed with a construct according to item 11 or 12.
15. Method for the production of a transgenic plant having increased yield, particularly increased biomass and/or increased seed yield relative to control plants, comprising:
    (i) introducing and expressing in a plant a nucleic acid encoding a CLC-like polypeptide as defined in item 1 or 2; and
    (ii) cultivating the plant cell under conditions promoting plant growth and development.
16. Transgenic plant having increased yield, particularly increased biomass and/or increased seed yield, relative to control plants, resulting from modulated expression of a nucleic acid encoding a CLC-like polypeptide as defined in item 1 or 2, or a transgenic plant cell derived from said transgenic plant.
17. Transgenic plant according to item 10, 14 or 16, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.
18. Harvestable parts of a plant according to item 17, wherein said harvestable parts are preferably shoot biomass and/or seeds.
19. Products derived from a plant according to item 17 and/or from harvestable parts of a plant according to item 18.
20. Use of a nucleic acid encoding a CLC-like polypeptide in increasing yield, particularly in increasing seed yield and/or shoot biomass in plants, relative to control plants.

Os-BURP-Like Polypeptides

21. A method for enhancing yield-related traits in plants relative to control plants, comprising modulating expression in a plant of a nucleic acid encoding an OsBURP-like polypeptide, wherein said OsBURP-like polypeptide comprises a BURP domain.
22. Method according to item 21, wherein said OsBURP-like polypeptide comprises one or more of the following motifs:

```
(i) Motif 9:
                                                              (SEQ ID NO: 140)
[HE][EK][HK]YCATSLESM[VI][DE][LF][SVA][TA]S[KS]LG, (ii) Motif 10:
                                                              (SEQ ID NO: 141)
V[VA]CH[RK][QEM][NP]Y[AP]YAVF[YG][VC]H[KGT][TIS][KE][AGT][AT], (iii) Motif 11:
                                                              (SEQ ID NO: 142)
[AP][VK][AH][EL]A[YF][QK][RVL][KG]V[AK]PG[TKS]V[PA]VCHFLPQD[DH][VMI]
[VL]W
```

23. Method according to item 21 or 22, wherein said modulated expression is effected by introducing and expressing in a plant a nucleic acid encoding a OsBURP-like polypeptide.
24. Method according to any one of items 21 to 23, wherein said nucleic acid encoding a OsBURP-like polypeptide encodes any one of the proteins listed in Table A2 or is a portion of such a nucleic acid, or a nucleic acid capable of hybridising with such a nucleic acid.
25. Method according to any one of items 21 to 24, wherein said nucleic acid sequence encodes an orthologue or paralogue of any of the proteins given in Table A2.
26. Method according to any preceding items 21 to 25, wherein said enhanced yield-related traits comprise increased yield and/or early vigour, preferably increased biomass and/or increased seed yield relative to control plants.
27. Method according to any one of items 21 to 26, wherein said enhanced yield-related traits are obtained under drought stress conditions.
28. Method according to any one of items 21 to 26, wherein said enhanced yield-related traits are obtained under conditions of salt stress.
29. Method according to any one of items 23 to 28, wherein said nucleic acid is operably linked to a constitutive promoter, preferably to a GOS2 promoter, most preferably to a GOS2 promoter from rice.
30. Method according to any one of items 21 to 29, wherein said nucleic acid encoding a OsBURP-like polypeptide is of plant origin, preferably from a monocotyledonous plant, further preferably from the family Poaceae, more preferably from the genus *Oryza*, most preferably from *Oryza sativa*.
31. Plant or part thereof, including seeds, obtainable by a method according to any one of items 21 to 30, wherein said plant or part thereof comprises a recombinant nucleic acid encoding a OsBURP-like polypeptide.
32. Construct comprising:
    (i) nucleic acid encoding a OsBURP-like polypeptide as defined in items 21 or 22;
    (ii) one or more control sequences capable of driving expression of the nucleic acid sequence of (i); and optionally
    (iii) a transcription termination sequence.
33. Construct according to item 32, wherein one of said control sequences is a constitutive promoter, preferably a GOS2 promoter, most preferably a GOS2 promoter from rice.
34. Use of a construct according to item 32 or 33 in a method for making plants having increased yield, particularly increased biomass and/or increased seed yield relative to control plants.
35. Plant, plant part or plant cell transformed with a construct according to item 32 or 33.
36. Method for the production of a transgenic plant having increased yield, particularly increased biomass and/or increased seed yield relative to control plants, comprising:

(i) introducing and expressing in a plant a nucleic acid encoding a OsBURP-like polypeptide as defined in item 21 or 22; and (ii) cultivating the plant cell under conditions promoting plant growth and development.

37. Transgenic plant having increased yield, particularly increased biomass and/or increased seed yield, relative to control plants, resulting from modulated expression of a nucleic acid encoding a OsBURP-like polypeptide as defined in item 21 or 22, or a transgenic plant cell derived from said transgenic plant.

38. Transgenic plant according to item 31, 35 or 37, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.

39. Harvestable parts of a plant according to item 38, wherein said harvestable parts are preferably shoot biomass and/or seeds.

40. Products derived from a plant according to item 38 and/or from harvestable parts of a plant according to item 39.

41. Use of a nucleic acid encoding a OsBURP-like polypeptide in increasing yield in plants, relative to control plants.

42. Use according to item 41 wherein said increased yield in plants relative to control plants is increased seed yield and/or shoot biomass in plants, relative to control plants.

AP2/ERF-Like Polypeptides

43. A method for enhancing yield-related traits in plants relative to control plants, comprising modulating expression in a plant of a nucleic acid encoding a AP2/ERF polypeptide, wherein said AP2/ERF polypeptide comprises an AP2/ERF domain.

44. Method according to item 43, wherein said AP2/ERF polypeptide comprises one or more of the following motifs:

```
(i)
Motif 25:
                                      (SEQ ID NO: 265)
GXRXRXWGXWVXEIRXPXXXXRXWLGSXXXXXXAAXAXDXA, (ii)
Motif 26:
                                      (SEQ ID NO: 266)
IXXXA, (iii)
Motif 27:
                                      (SEQ ID NO: 267)
DXNXXP (iv)
Motif 28:
                                      (SEQ ID NO: 268)
LWXF
``` wherein X indicates no conservation in the respective position.

45. Method according to items 43 or 44, wherein said AP2/ERF polypeptide comprises Motif 25 and at least Motif 26.

46. Method according to any of items 43 to 45, wherein said AP2/ERF polypeptide comprises Motif 25, Motif 26 and Motif 27 or Motif 28.

47. Method according to any of items 43 to 46, wherein said AP2/ERF polypeptide comprises Motif 25, Motif 26 and Motif 27.

48. Method according to any of items 43 to 47, wherein said modulated expression is effected by introducing and expressing in a plant a nucleic acid encoding an AP2/ERF polypeptide.

49. Method according to any of items 43 to 48, wherein said nucleic acid encoding an AP2/ERF polypeptide encodes any one of the proteins listed in Table A3 or is a portion of such a nucleic acid, or a nucleic acid capable of hybridising with such a nucleic acid.

50. Method according to item 49, wherein said nucleic acid sequence encodes an orthologue or paralogue of any of the proteins given in Table A3.

51. Method according to any of items 43 to 50, wherein said enhanced yield-related traits comprise increased yield, preferably increased biomass and/or increased seed yield relative to control plants.

52. Method according to any of items 43 to 51, wherein said increased biomass relative to control plants comprises early vigour, maximum height, total root biomass and harvest index.

53. Method according to any of items 43 to 52, wherein said increased seed yield relative to control plants comprises total seed weight, number of filled seeds and fill rate.

54. Method according to any one of items 43 to 53, wherein said enhanced yield-related traits are obtained under drought-stress conditions.

55. Method according to any one of items 43 to 53, wherein said enhanced yield-related traits are obtained under conditions of drought stress, salt stress or nitrogen deficiency.

56. Method according to item 55, wherein said enhanced yield-related traits are obtained under conditions of drought stress.

57. Method according to any of items 43 to 56, wherein said nucleic acid is operably linked to a constitutive promoter, preferably to a GOS2 promoter, most preferably to a GOS2 promoter from rice.

58. Method according to any of items 43 to 57, wherein said nucleic acid encoding a AP2/ERF polypeptide is of plant origin, preferably from a dicotyledonous plant, further preferably from the family Fabaceae, more preferably from the genus *Medicago*, most preferably from *M. truncatula*.

59. Plant or part thereof, including seeds, obtainable by a method according to any one of items 43 to 58, wherein said plant or part thereof comprises a recombinant nucleic acid encoding an AP2/ERF polypeptide.

60. Construct comprising:
    (i) nucleic acid encoding a AP2/ERF polypeptide as defined in items 43 to 47;
    (ii) one or more control sequences capable of driving expression of the nucleic acid sequence of (I); and optionally
    (iii) a transcription termination sequence.

61. Construct according to item 60, wherein one of said control sequences is a constitutive promoter, preferably a GOS2 promoter, most preferably a GOS2 promoter from rice.

62. Use of a construct according to the item 60 or 61 in a method for making plants having increased yield, particularly increased biomass and/or increased seed yield relative to control plants.

63. Plant, plant part or plant cell transformed with a construct according to item 60 or 61.

64. Method for the production of a transgenic plant having increased yield, particularly increased biomass and/or increased seed yield relative to control plants, comprising:
    (i) introducing and expressing in a plant a nucleic acid encoding an AP2/ERF polypeptide as defined in item 43 to 47; and
    (ii) cultivating the plant cell under conditions promoting plant growth and development.

65. Transgenic plant having increased yield, particularly increased biomass and/or increased seed yield, relative to control plants, resulting from modulated expression of a nucleic acid encoding an AP2/ERF polypeptide as defined in items 43 to 47 or a transgenic plant cell derived from said transgenic plant.

66. Transgenic plant according to item 59, 63 or 65, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.

67. Harvestable parts of a plant according to item 66, wherein said harvestable parts are preferably shoot biomass and/or seeds.

68. Products derived from a plant according to item 66 and/or from harvestable parts of a plant according to item 67.

69. Use of a nucleic acid encoding an AP2/ERF polypeptide in increasing yield, particularly in increasing seed yield and/or shoot biomass in plants, relative to control plants.

TPS, TPP and TPS-TPP Polypeptide

70. A method for enhancing yield-related traits in plants relative to control plants, comprising modulating expression in a plant of:
    (i) a nucleic acid encoding a TPS-TPP protein fusion: fusion between a TPS polypeptide or an active portion thereof and a TPP polypeptide or an active portion thereof; or
    (ii) a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules.

71. A method according to item 70 wherein
    (i) the TPS polypeptide or active portion thereof has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% overall sequence identity to the amino acid represented by any one of the polypeptide sequences of Table A4 or an active portion thereof, more preferably by SEQ ID NO: 273 or an active portion thereof or SEQ ID NO: 275 or an active portion thereof;
    (ii) the TPP polypeptide or an active portion thereof has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% overall sequence identity to the amino acid represented by any one of the polypeptide sequences of Table A5 or an active portion thereof, more preferably by SEQ ID NO: 299 or an active portion thereof or SEQ ID NO: 301 or an active portion thereof.

72. Method according to items 70 or 71, wherein said modulated expression is effected by introducing and expressing in a plant:
    (i) a nucleic acid encoding a TPS-TPP protein fusion, preferably having in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% overall sequence identity to the amino acid represented by any one of the polypeptide sequences of Table A6 or an active portion thereof, more preferably by SEQ ID NO: 440 or an active portion thereof, or SEQ ID NO: 442 or an active portion thereof, or SEQ ID NO: 444 or an active portion thereof; or
    (ii) a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules.

73. Method according to items 70 to 72 wherein said one or more nucleic acids are expressed in the chloroplast of a plant cell, plant or plant part thereof and preferably comprise a sequence encoding a chloroplast targeting signal, further preferably said sequence is located at the 5' terminus of the coding region, even more preferably encodes any one of the polypeptide chloroplast targeting signals of Table 3, most preferably encodes SEQ ID NO: 456 or a portion thereof.

74. Method according to any of items 70 to 73, wherein said enhanced yield-related traits comprise any one or more of increased size or number of floral meristems, increased number of flowers, increased number of seeds, increased yield, preferably increased biomass and/or increased seed weight relative to control plants.

75. Method according to any of items 70 to 74, wherein said enhanced yield-related traits are obtained under plant cell, plant culturing conditions where nitrogen would be limiting for growth for the control plant cell, plant or a part thereof.

76. Method according to any of items 70 to 75, wherein said enhanced yield-related traits are obtained under non-stress conditions or under stress conditions selected from any one or more of drought, salt and cold stress.

77. Method according to any one of items 72 to 76, wherein said one or more said nucleic acids are operably linked to a plant promoter, preferably to a constitutive promoter, more preferably to a GOS2 promoter, most preferably to a GOS2 promoter from rice.

78. Method according to any of items 70 to 76, wherein said one or more said nucleic acids is of plant origin preferably from a dicotyledonous plant, further preferably from the family Brassicaceae, more preferably from the genus *Arabidopsis*, most preferably from *Arabidopsis thaliana* or of bacterial origin preferably from *Saccharomyces* more preferably from *Saccharomyces* cerevisie.

79. Plant or part thereof, including seeds, obtainable by a method according to any any of items 70 to 75, wherein said plant or part thereof comprises:
    (i) a nucleic acid encoding a TPS-TPP protein fusion; or
    (ii) a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules; or (iii) said one or more nucleic acids of (i) and (ii) further comprising a sequence encoding a chloroplast targeting signal.

80. Construct comprising:
(i) a nucleic acid encoding a TPS-TPP protein fusion; or
(ii) a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules; or
(iii) said one or more nucleic acids of (i) and (ii) further comprising a sequence encoding a chloroplast targeting signal; and
(iv) one or more control sequences capable of driving expression of the nucleic acid sequence of (i), (ii) and (iii), preferably a plant promoter, more preferably a constitutive promoter, even more preferably a GOS2 promoter, most preferably a GOS2 promoter from rice; and optionally
(v) a transcription termination sequence.

81. Use of a construct according to item 80 in a method for making plants having any one or more of increased size or number of floral meristems, increased number of flowers, increased number of seeds, increased yield, preferably increased biomass and/or increased seed weight relative to control plants.

82. Plant, plant part or plant cell transformed with a construct according to item 80.

83. Method for the production of a transgenic plant having any one or more of increased size or number of floral meristems, increased number of flowers, increased number of seeds, increased yield, preferably increased biomass and/or increased seed weight relative to control plants, comprising:
(i) a nucleic acid encoding a TPS-TPP protein fusion; or
(ii) a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules; or
(iii) said one or more nucleic acids of (i) and (ii) further comprising a sequence encoding a chloroplast targeting signal; and
(iv) cultivating the plant cell under conditions promoting plant growth and development.

84. Transgenic plant having any one or more of increased size or number of floral meristems, increased number of flowers, increased number of seeds, increased yield, preferably increased biomass and/or increased seed weight relative to control plants, resulting from modulated expression of a first nucleic acid encoding:
(i) a nucleic acid encoding a TPS-TPP protein fusion; or
(ii) a first nucleic acid encoding a TPS polypeptide or an active portion thereof, and a second nucleic acid encoding a TPP polypeptide or an active portion thereof, wherein the first and second nucleic acids are comprised in a single or in multiple, at least two, nucleic acid molecules; or
(iii) said one or more nucleic acids of (i) and (ii) further comprising a sequence encoding a chloroplast targeting signal; or a transgenic plant cell derived from said transgenic plant.

85. Transgenic plant according to item 79, 82 or 84, or a transgenic plant part or cell derived thereof, wherein said plant is a crop plant or a monocot or a cereal, such as rice, maize, wheat, barley, millet, rye, triticale, sorghum emmer, spelt, secale, einkorn, teff, milo and oats.

86. Harvestable parts of a plant according to item 85, wherein said harvestable parts are preferably shoot biomass and/or seeds.

87. Products derived from a plant according to item 84 or 85 and/or from harvestable parts of a plant according to item 86.

88. Use of any one, two or more nucleic acids according to item 70 to 73 in increasing yield, particularly in increasing seed yield and/or shoot biomass in plants, relative to control plants.

DESCRIPTION OF FIGURES

The present invention will now be described with reference to the following figures in which:

FIG. 1 represents the domain structure of SEQ ID NO: 2 with the Voltage_CLC domain (PF00654) shown in bold and the CBS domain (PF00571) in bold italics. The conserved motifs 1 to 8 are underlined and numbered.

FIG. 2 represents a multiple alignment of various CLC-like polypeptides. The asterisks indicate identical amino acids among the various protein sequences, colons represent highly conserved amino acid substitutions, and the dots represent less conserved amino acid substitution; on other positions there is no sequence conservation. These alignments can be used for defining further motifs, when using conserved amino acids. AT5g40890: SEQ ID NO: 10; AT3G27170: SEQ ID NO: 4; Pt 829777: SEQ ID NO: 72; Gm19g25680__2: SEQ ID NO: 26; Gm19g25680__1: SEQ ID NO: 24; Gm16g06190: SEQ ID NO: 22; Gm_TC286373: SEQ ID NO: 28; Gm05g14760: SEQ ID NO: 16; Os_TC285852: SEQ ID NO: 2; Os03g48940__1: SEQ ID NO: 42; Os_TC299772: SEQ ID NO: 56; Os03g48940__2: SE ID NO: 44; Gm01g44950: SEQ ID NO: 14; Gm11g00690: SEQ ID NO: 18; AT5G26240: SEQ ID NO: 6; Pp__151168: SEQ ID NO: 66; and Pp 105025: SEQ ID NO: 64.

FIG. 5 represents the domain structure of SEQ ID NO: 95 with conserved motifs 9 to 24 and the BURP domain shown in bold. The cleavage site of the N-terminal secretion signal is underlined (SH<u>AA</u>SP; SEQ ID NO: 526).

FIG. 6 represents a multiple alignment of various OsBURP-like polypeptides. The asterisks indicate identical amino acids among the various protein sequences, colons represent highly conserved amino acid substitutions, and the dots represent less conserved amino acid substitution; on other positions there is no sequence conservation. These alignments can be used for defining further motifs, when using conserved amino acids. AtRD22_AT5G25610.1#1: SEQ ID NO: 109; Brassica_napus_AY293830#1: SEQ ID NO: 111; Bruguiera_gymnorhiza_AB062746#1: SEQ ID NO: 127; P.trichocarpa__561796#1: SEQ ID NO: 123; Gossypium_arboreum_AY641990#1: SEQ ID NO: 133; Gossypium_hirsutum_AY343972#1: SEQ ID NO: 137; Gossypium_hirsutum_AY072821#1: SEQ ID NO: 135; Gossypium_arboreum_AY641991#1: SEQ ID NO: 131; Glycine_max_EU679375#1: SEQ ID NO: 139; Medicago_truncatula_BT051769#1: SEQ ID NO: 121; Mt_

BURP_dist: SEQ ID NO: 129; Hordeum_vulgare_subsp_vulgare_AK252727#1: SEQ ID NO: 107; Triticum_aestivum_AJ575664#1: SEQ ID NO: 105; Os_BURP_dist_BURP02: SEQ ID NO: 95; OsBURP01: SEQ ID NO: 99; OsBURP06: SEQ ID NO: 103; OsBURP07: SEQ ID NO: 97; OsBURP08: SEQ ID NO: 101; OsBURP05: SEQ ID NO: 119; OsBURP17: SEQ ID NO: 113; OsBURP03: SEQ ID NO: 115; Zea_mays_BT036729#1: SEQ ID NO: 117; Vitis: SEQ ID NO: 125; and Consensus: SEQ ID NO: 504.

Figure 7:
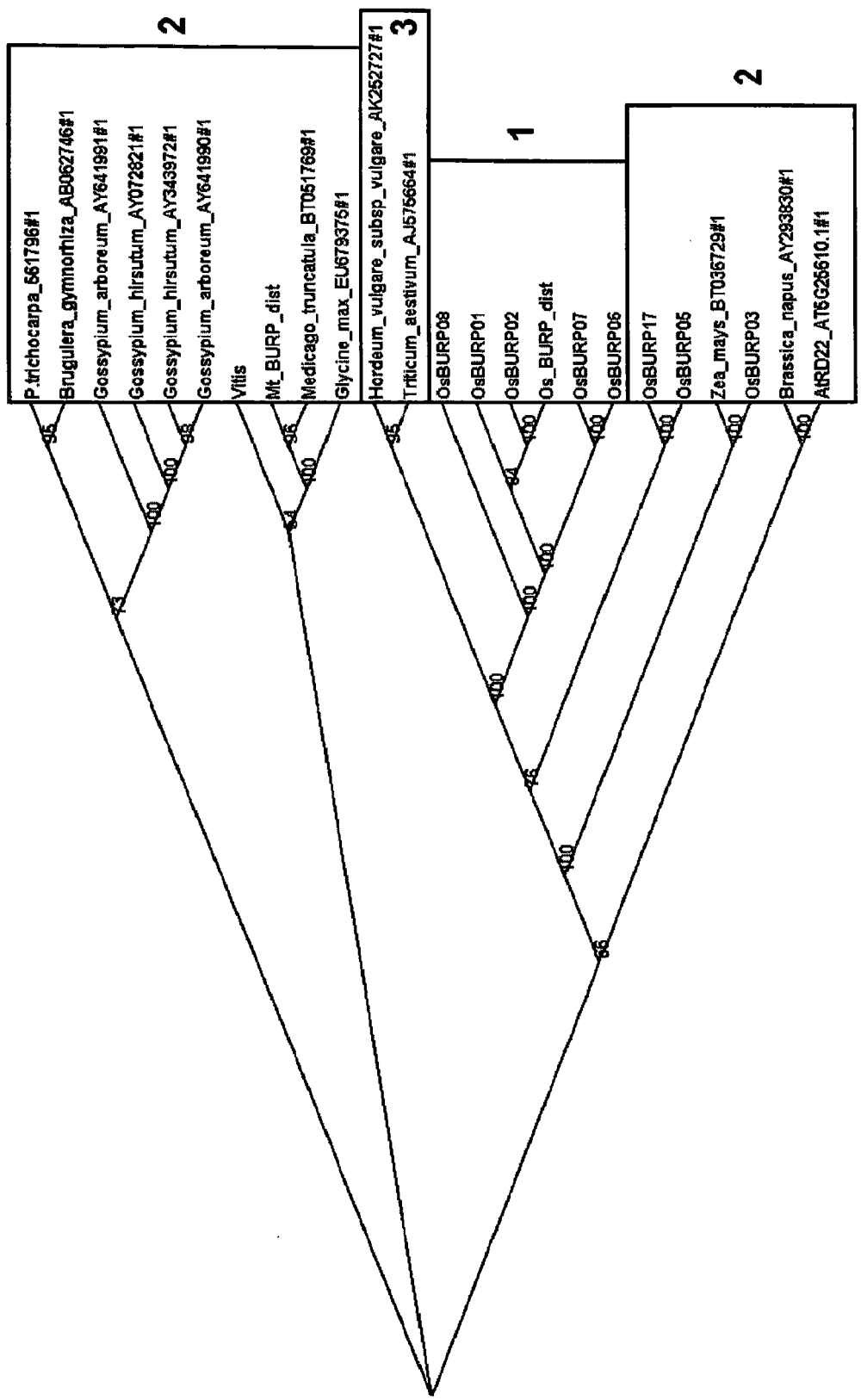

FIG. 7 shows phylogenetic tree of OsBURP-like polypeptides. Small boxes frame the clades identified in context with the present invention (1=clade A1, which corresponds to BURP V according to Ding et al 2009 and contain only Oryza sativa OsBURP-like polypeptides; 2=clade B, which corresponds to RD-22-like according to Ding et al 2009, 3=clade A1, which are not rice OsBURP-like polypeptides but closely relate to clade A1, 4=clade C, not characterized before.

Figure 8:
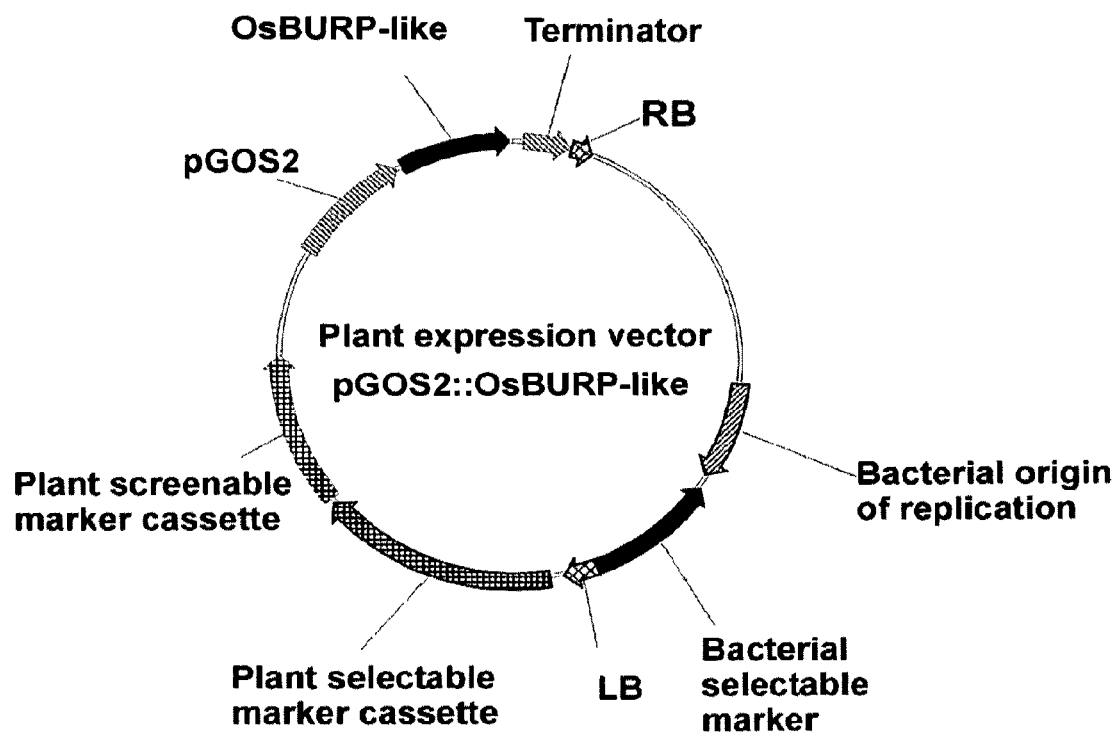

FIG. 8 represents the binary vector used for increased expression in Oryza sativa of a OsBURP-like-encoding nucleic acid under the control of a rice GOS2 promoter (pGOS2)

FIG. 9 represents the domain definition of AP2/ERF genes. AtERF#100: SEQ ID NO: 505; AtERF#001: SEQ ID NO: 506; AtERF#007: SEQ ID NO: 507; AtERF#029: SEQ ID NO: 508; AtERF#040: SEQ ID NO: 509; AtERF#045: SEQ ID NO: 510; AtERF#052: SEQ ID NO: 511; AtERF#059: SEQ ID NO: 512; AtERF#063: SEQ ID NO: 513; AtERF#072: SEQ ID NO: 514; AtERF#085: SEQ ID NO: 515; AtERF#089: SEQ ID NO: 516; AtERF#100: SEQ ID NO: 505; AtERF#092: SEQ ID NO: 517; AtERF#108: SEQ ID NO: 518; AtERF#119: SEQ ID NO: 519; AtERF#116: SEQ ID NO: 520; AtERF#118: SEQ ID NO: 521; AtERF#117: SEQ ID NO: 522; AtERF#120: SEQ ID NO: 523; AtERF#122: SEQ ID NO: 524; and AtERF#121: SEQ ID NO: 525.

FIG. 10 represents a multiple alignment of various AP2/ERF polypeptides belonging to class IIa. The asterisks indicate identical amino acids among the various protein sequences, colons represent highly conserved amino acid substitutions, and the dots represent less conserved amino acid substitution; on other positions there is no sequence conservation. These alignments can be used for defining further motifs, when using conserved amino acids. G_max_Glyma17g18580_1: SEQ ID NO: 216; G_max_Glyma05g19050_1: SEQ ID NO: 214; G_max_Glyma01g39540_1: SEQ ID NO: 198; MtAp2ERF_CDS_: SEQ ID NO: 160; M_truncatula_TC117996_CDS_: SEQ ID NO: 160; P_trichocarpa_TC111318: SEQ ID NO: 196; P_trichocarpa_TC91546: SEQ ID NO: 194; P_trichocarpa_CV260432: SEQ ID NO: 192; A_thaliana_AT3G50260_1: SEQ ID NO: 246; B_napus_TC67876: SEQ ID NO: 174; B_napus_BN06MC02259_42032738_2254: SEQ ID NO: 242; B_napus_TC73559: SEQ ID NO: 244; B_napus_TC68928: SEQ ID NO: 210; A_thaliana_AT5G67190_1: SEQ ID NO: 208; B_napus_TC79173: SEQ ID NO: 182; B_napus_TC89313: SEQ ID NO: 184; A_thaliana_AT2G23340_1: SEQ ID NO: 186; B_napus_TC86323: SEQ ID NO: 180; B_napus_TC72792: SEQ ID NO: 190; A_thaliana_AT4G36900_1_CDS_: SEQ ID NO: 188; H_annuus_TC30931: SEQ ID NO: 204; H_annuus_TC31134: SEQ ID NO: 176; S_lycopersicum_TC196769_CDS: SEQ ID NO: 172; P_trichocarpa_826816: SEQ ID NO: 212; P_trichocarpa_644094: SEQ ID NO: 218; G_max_TC258747: SEQ ID NO: 224; G_max_Glyma14g09320_1: SEQ ID NO: 226; G_max_TC266306: SEQ ID NO: 220; M_truncatula_TC129893_CDS_: SEQ ID NO: 222; M_truncatula_TC125274: SEQ ID NO: 162; H_annuus_HA04MC01018_66822928_1017: SEQ ID NO: 230; H_annuus_TC34117: SEQ ID NO: 228; S_lycopersicum_TC213116: SEQ ID NO: 206; A_thaliana_AT1G46768_1: SEQ ID NO: 200; T_aestivum_TC277269: SEQ ID NO: 202; O_sativa_Os06g0166400: SEQ ID NO: 238; TraitMillCDS_: SEQ ID NO: 178; O_sativa_TC312964_CDS_: SEQ ID NO: 240; Z_mays_TA32842_4577999: SEQ ID NO: 234; O_sativa_LOC_Os04g55520_1: SEQ ID NO: 170; T_aestivum_TC314990: SEQ ID NO: 166; T_aestivum_TC277211: SEQ ID NO: 168; and A_thaliana_AT4G06746_1: SEQ ID NO: 164.

Figure 11:
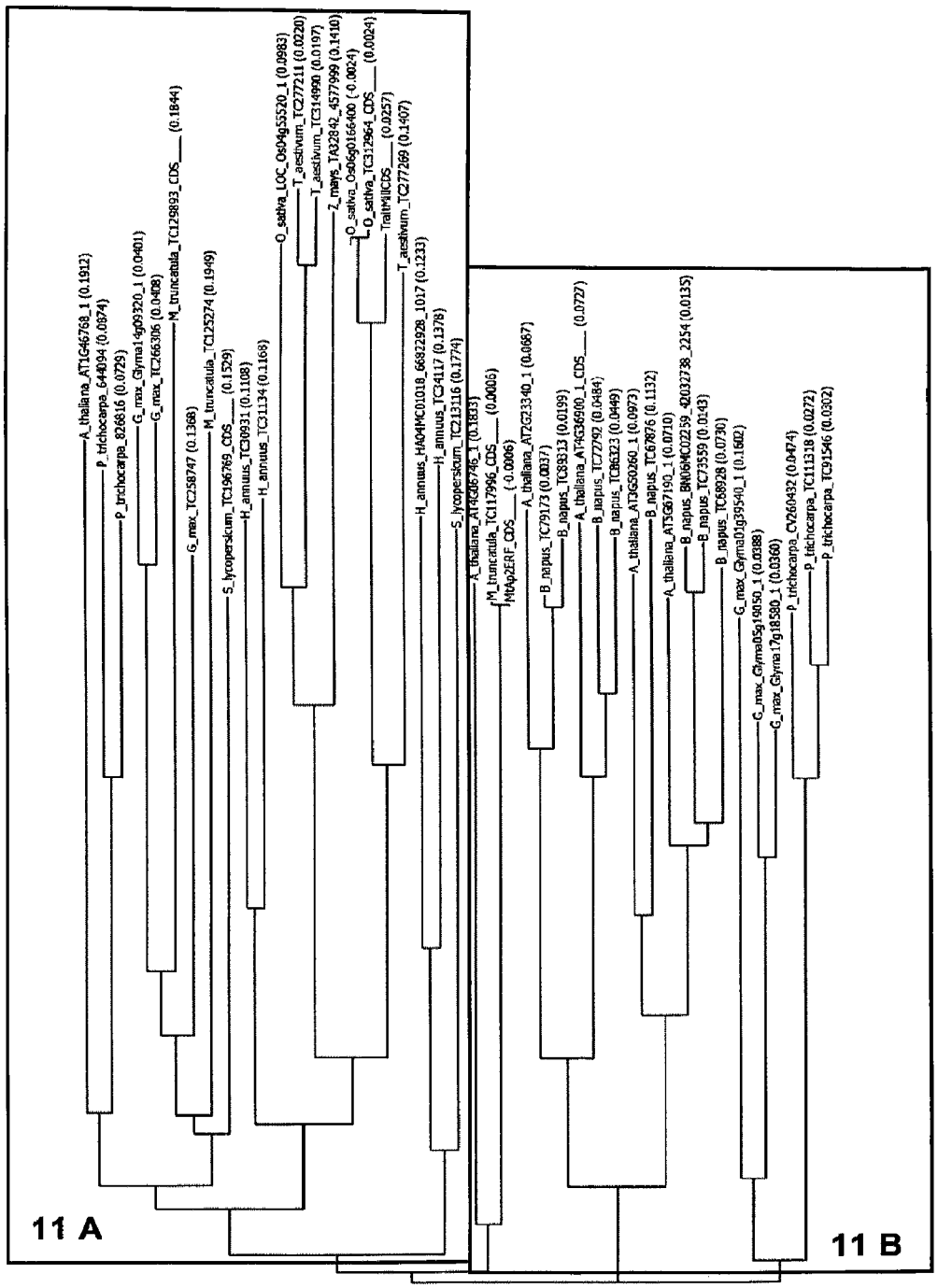
Figure 11:
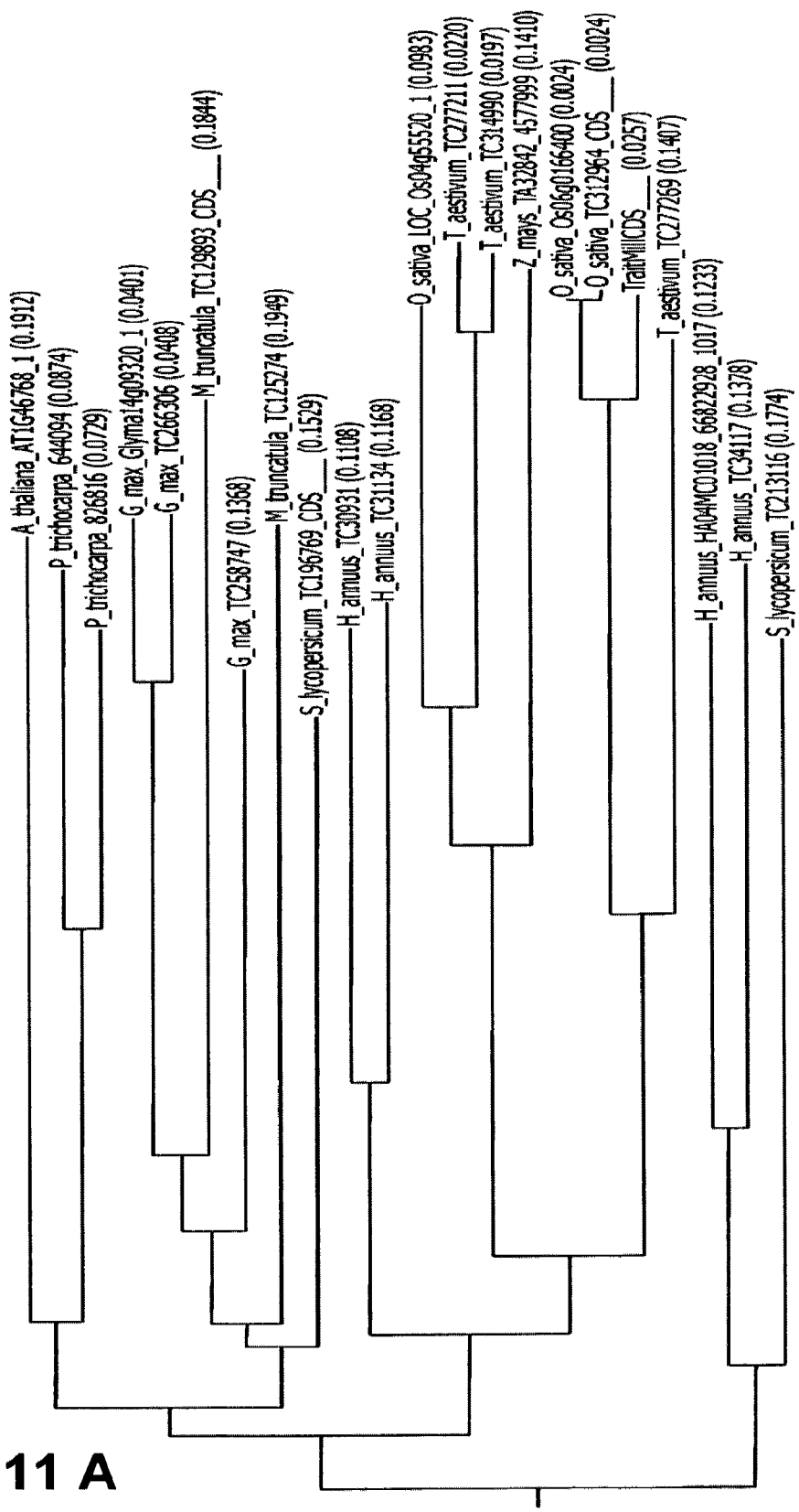
Figure 11:
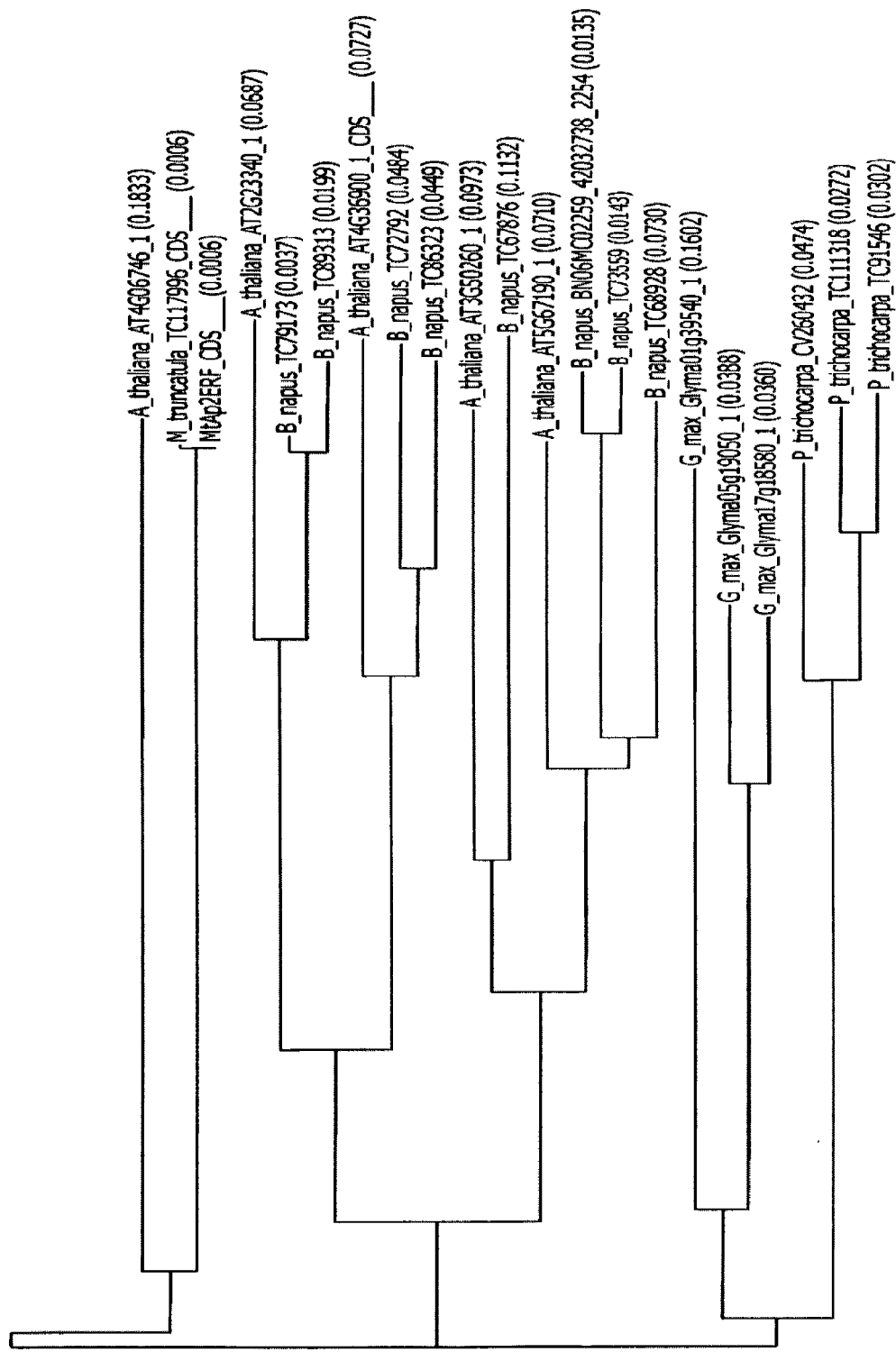

FIG. 11 shows phylogenetic tree of AP2/ERF polypeptides of class IIa.

Figure 12:
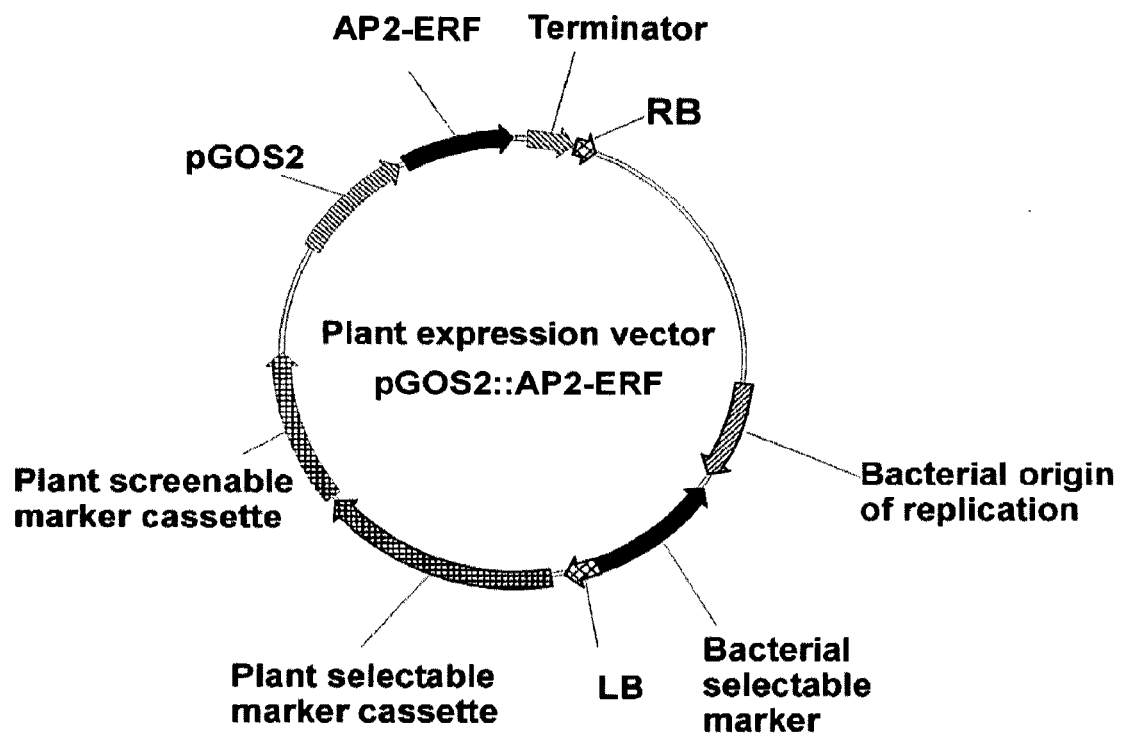

FIG. 12 represents the binary vector used for increased expression in Oryza sativa of an AP2/ERF-encoding nucleic acid under the control of a rice GOS2 promoter (pGOS2)

Figure 13:
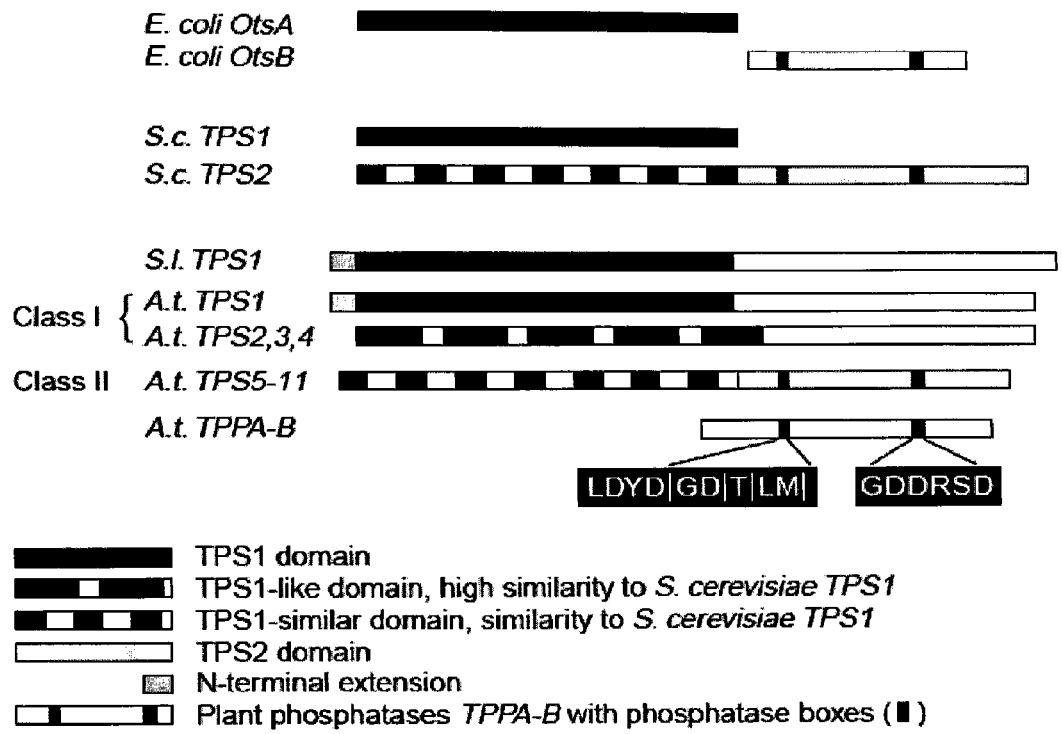

FIG. 13 Distribution of the TPS (homologous to OtsA) and TPP (homologous to OtsB) domains within the different trehalose biosynthesis genes. E. coli OtsA and OtsB; Saccharomycescerevisiae (S.c.) TPS1 and TPS2, Selaginella lepidophylla (Sl) TPS1, Arabidopsis thaliana (A.t.) Class I: TPS1-4, A. thaliana TPP Class II:TPS5-11 and A. thaliana TPPA-B classes. Figure reproduced from FIG. 1 of Leyman et al. 2001 TRENDS in Plant Science 6 vol. 11, 510-513.

Figure 14:
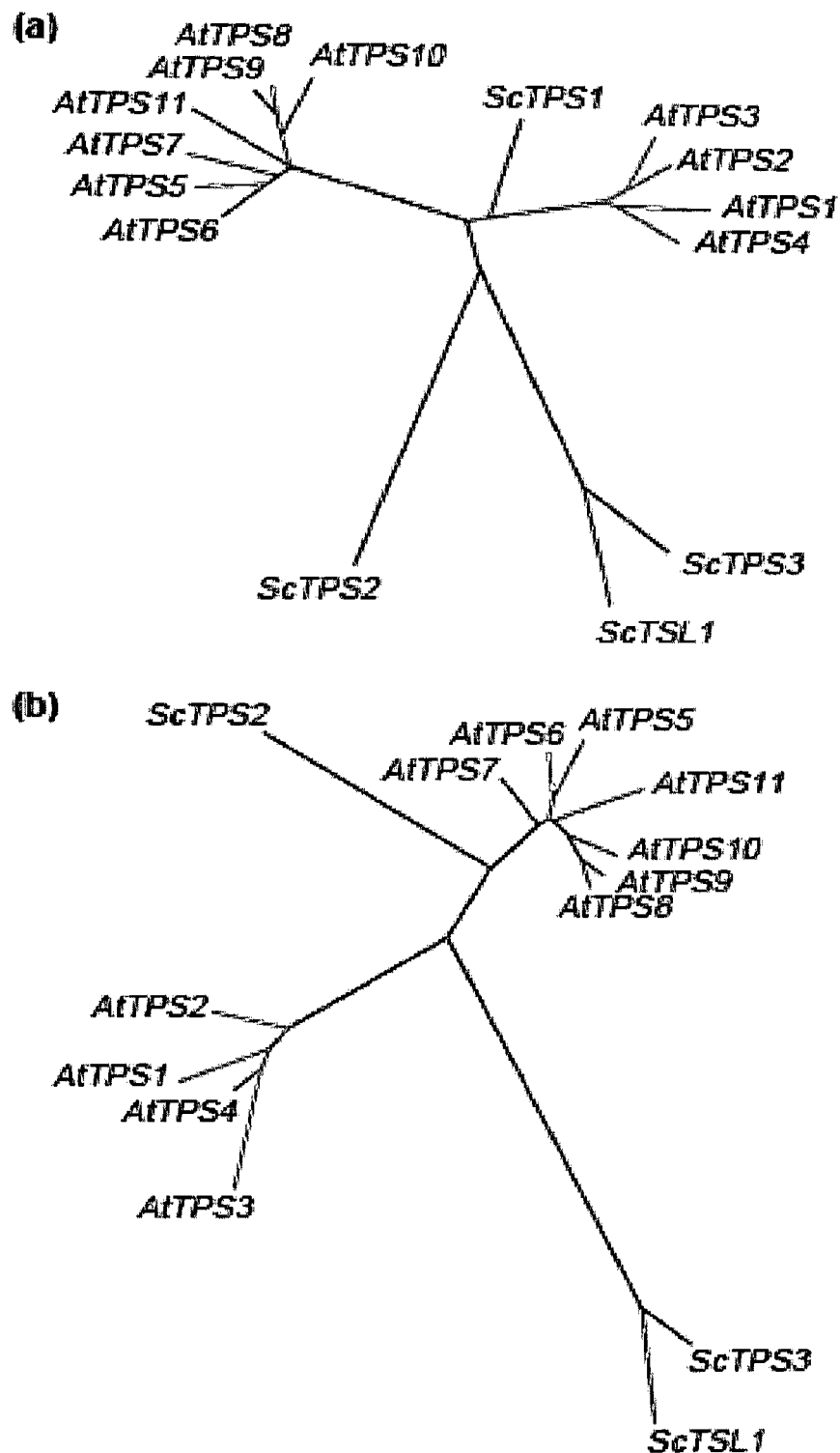

FIG. 14 Phylogenetic tree of TPS and TPP genes of Arabidopsis thaliana (a) and S. cerevisie (b) origin. Figure reproduced from FIG. 2 of Leyman et al. 2001 TRENDS in Plant Science 6 vol. 11, 510-513.

Figure 15:
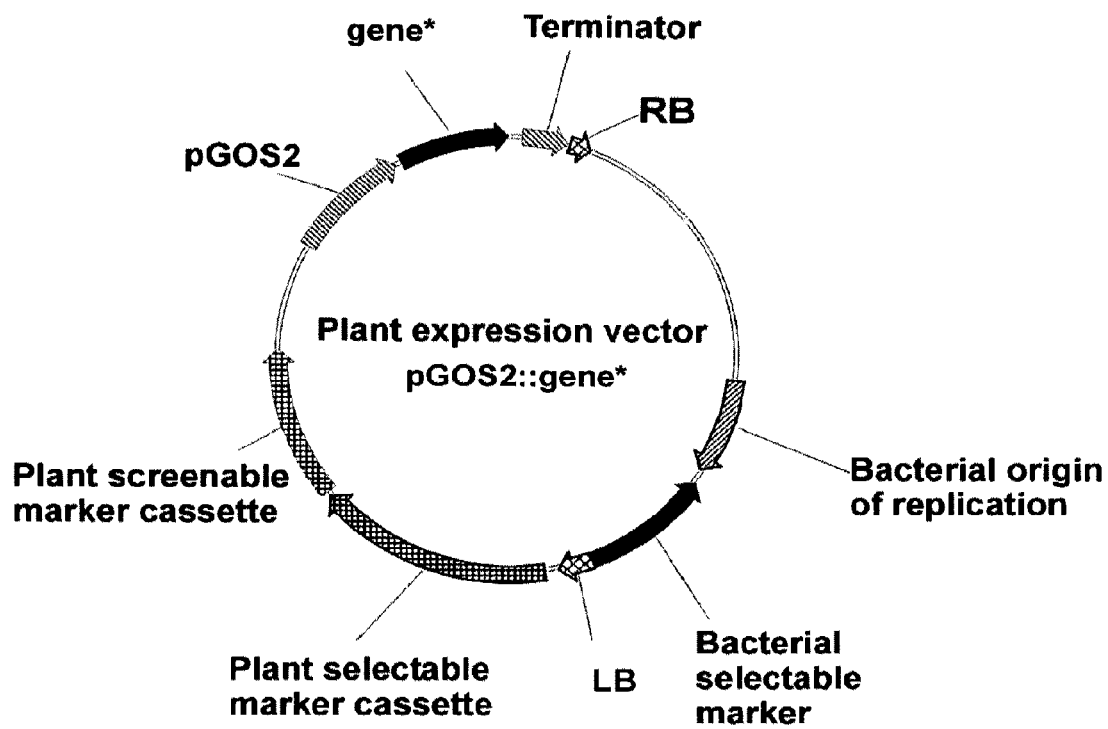

FIG. 15 Vector indicating 3 different possible Gene-fusions of Interest. There are 3 gene fusions described in the examples in 3 vectors: pGOS2:: A.thaliana_DNTPS1-TPPB; pGOS2:: S.cerevisiae_TPS1/TPS2_fusion; pS.cerevisiae_TPS1/TPS2_fusion.

EXAMPLES

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of Intervention 1.1 CLC-Like Polypeptides Sequences (full length cDNA, ESTs or genomic) related to SEQ ID NO: 1 and SEQ ID NO: 2 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol.

215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 1 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Table A1 provides a list of nucleic acid sequences related to SEQ ID NO: 1 and SEQ ID NO: 2.

TABLE A1

Examples of CLC-like nucleic acids and polypeptides:

| Plant Source | Nucleic acid SEQ ID NO: | Protein SEQ ID NO: |
|---|---|---|
| >O_sativa_TC285852 | 1 | 2 |
| >A_thaliana_AT3G27170_1 | 3 | 4 |
| >A_thaliana_AT5G26240_1 | 5 | 6 |
| >A_thaliana_AT5G33280_1 | 7 | 8 |
| >A_thaliana_AT5g40890_1 | 9 | 10 |
| >A_thaliana_AT5G49890_1 | 11 | 12 |
| >G_max_Glyma01g44950_1 | 13 | 14 |
| >G_max_Glyma05g14760_1 | 15 | 16 |
| >G_max_Glyma11g00690_1 | 17 | 18 |
| >G_max_Glyma13g23080_1 | 19 | 20 |
| >G_max_Glyma16g06190_1 | 21 | 22 |
| >G_max_Glyma19g25680_1 | 23 | 24 |
| >G_max_Glyma19g25680_2 | 25 | 26 |
| >G_max_TC286373 | 27 | 28 |
| >M_truncatula_AC147497_49_5 | 29 | 30 |
| >M_truncatula_NP7258079 | 31 | 32 |
| >M_truncatula_TC137578 | 33 | 34 |
| >O_sativa_AK066027 | 35 | 36 |
| >O_sativa_LOC_Os01g65500_1 | 37 | 38 |
| >O_sativa_LOC_Os02g35190_1 | 39 | 40 |
| >O_sativa_LOC_Os03g48940_1 | 41 | 42 |
| >O_sativa_LOC_Os03g48940_2 | 43 | 44 |
| >O_sativa_LOC_Os04g36560_1 | 45 | 46 |
| >O_sativa_LOC_Os04g55210_1 | 47 | 48 |
| >O_sativa_LOC_Os08g20570_1 | 49 | 50 |
| >O_sativa_LOC_Os08g20570_2 | 51 | 52 |
| >O_sativa_TC286403 | 53 | 54 |
| >O_sativa_TC299772 | 55 | 56 |
| >O_sativa_TC300750 | 57 | 58 |
| >O_sativa_TC300965 | 59 | 60 |
| >O_sativa_TC315324 | 61 | 62 |
| >P_patens_105025 | 63 | 64 |
| >P_patens_151168 | 65 | 66 |
| >P_trichocarpa_810626 | 67 | 68 |
| >P_trichocarpa_811492 | 69 | 70 |
| >P_trichocarpa_829777 | 71 | 72 |
| >P_trichocarpa_837368 | 73 | 74 |
| >P_trichocarpa_scaff_150_21 | 75 | 76 |
| >P_trichocarpa_scaff_152_78 | 77 | 78 |
| >P_trichocarpa_scaff_86_63 | 79 | 80 |
| >Z_mays_ZM07MC27833_BFb0208A07@27749 | 81 | 82 |

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute. Furthermore, access to proprietary databases, has allowed the identification of novel nucleic acid and polypeptide sequences.

1.2 OsBURP-Like Polypeptides

Sequences (full length cDNA, ESTs or genomic) related to SEQ ID NO: 94 and SEQ ID NO: 95 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 94 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Table A2 provides a list of nucleic acid sequences related to SEQ ID NO: 94 and SEQ ID NO: 95.

TABLE A2

Examples of OsBURP-like nucleic acids and polypeptides:

| Plant Source | Nucleic acid SEQ ID NO: | Polypeptide SEQ ID NO: |
|---|---|---|
| Oryza sativa_BURP_dist_OsBURP02 | 94 | 95 |
| O. sativa BURP07 | 96 | 97 |
| O. sativa BURP01 | 98 | 99 |
| O. sativa BURP08 | 100 | 101 |
| O. sativa BURP06 | 102 | 103 |
| Triticum_aestivum_AJ575664 | 104 | 105 |
| Hordeum_vulgare_subsp_vulgare_AK252727 | 106 | 107 |
| A. thaliana RD22_AT5G25610.1 | 108 | 109 |
| Brassica_napus_AY293830 | 110 | 111 |
| O. sativa OsBURP17 | 112 | 113 |
| O. sativa OsBURP03 | 114 | 115 |
| Zea_mays_BT036729 | 116 | 117 |
| O. sativa OsBURP05 | 118 | 119 |
| Medicago_truncatula_BT051769 | 120 | 121 |
| P.trichocarpa_561796 | 122 | 123 |
| Vitis vinifera_LOC100249127 | 124 | 125 |
| Bruguiera_gymnorhiza_AB062746 | 126 | 127 |
| Mt_BURP_dist | 128 | 129 |
| Gossypium_arboreum_AY641991 | 130 | 131 |
| Gossypium_arboreum_AY641990 | 132 | 133 |

TABLE A2-continued

Examples of OsBURP-like nucleic acids and polypeptides:

| Plant Source | Nucleic acid SEQ ID NO: | Polypeptide SEQ ID NO: |
|---|---|---|
| Gossypium_hirsutum_AY072821 | 134 | 135 |
| Gossypium_hirsutum_AY343972 | 136 | 137 |
| Glycine_max_EU679375 | 138 | 139 |

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute. Furthermore, access to proprietary databases, has allowed the identification of novel nucleic acid and polypeptide sequences.

1.3 AP2/ERF-Like Polypeptides

Sequences (full length cDNA, ESTs or genomic) related to SEQ ID NO: 159 and SEQ ID NO: 160 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 159 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Table A3 provides a list of nucleic acid sequences related to SEQ ID NO: 159 and SEQ ID NO: 160.

TABLE A3

Examples of AP2/ERF nucleic acids and polypeptides

| Name | Nucleic acid SEQ ID NO: | Polypeptide SEQ ID NO: |
|---|---|---|
| M_truncatula_TC117996#1_CDS | 159 | 160 |
| M_truncatula_TC125274#1 | 161 | 162 |
| A_thaliana_AT4G06746_1#1 | 163 | 164 |
| T_aestivum_TC314990#1 | 165 | 166 |
| T_aestivum_TC277211#1 | 167 | 168 |
| O_sativa_LOC_Os04g55520_1#1 | 169 | 170 |
| S_lycopersicum_TC196769#1_CDS | 171 | 172 |
| B_napus_TC67876#1 | 173 | 174 |
| H_annuus_TC31134#1 | 175 | 176 |
| TraitMillCDS_ | 177 | 178 |
| B_napus_TC86323#1 | 179 | 180 |
| B_napus_TC79173#1 | 181 | 182 |
| B_napus_TC89313#1 | 183 | 184 |
| A_thaliana_AT2G23340_1#1 | 185 | 186 |
| A_thaliana_AT4G36900_1#1_CDS | 187 | 188 |
| B_napus_TC72792#1 | 189 | 190 |
| P_trichocarpa_CV260432#1 | 191 | 192 |
| P_trichocarpa_TC91546#1 | 193 | 194 |
| P_trichocarpa_TC111318#1 | 195 | 196 |
| G_max_Glyma01g39540_1#1 | 197 | 198 |
| A_thaliana_AT1G46768_1#1 | 199 | 200 |
| T_aestivum_TC277269#1 | 201 | 202 |
| H_annuus_TC30931#1 | 203 | 204 |
| S_lycopersicum_TC213116#1 | 205 | 206 |
| A_thaliana_AT5G67190_1#1 | 207 | 208 |
| B_napus_TC68928#1 | 209 | 210 |
| P_trichocarpa_826816#1 | 211 | 212 |
| G_max_Glyma05g19050_1#1 | 213 | 214 |
| G_max_Glyma17g18580_1#1 | 215 | 216 |
| P_trichocarpa_644094#1 | 217 | 218 |
| G_max_TC266306#1 | 219 | 220 |
| M_truncatula_TC129893#1_CDS | 221 | 222 |
| G_max_TC258747#1 | 223 | 224 |
| G_max_Glyma14g09320_1#1 | 225 | 226 |
| H_annuus_TC34117#1 | 227 | 228 |
| H_annuus_HA04MC01018_66822928_1017#1 | 229 | 230 |
| Z_mays_TC411151#1 | 231 | 232 |
| Z_mays_TA32842_4577999#1 | 233 | 234 |
| Z_mays_TC403235#1 | 235 | 236 |
| O_sativa_Os06g0166400#1 | 237 | 238 |
| O_sativa_TC312964#1_CDS | 239 | 240 |
| B_napus_BN06MC02259_42032738_2254#1 | 241 | 242 |
| B_napus_TC73559#1 | 243 | 244 |
| A_thaliana_AT3G50260_1#1 | 245 | 246 |
| AT1G21910.1 | 247 | 248 |
| AT1G77640.1 | 249 | 250 |
| AT1G44830.1 | 251 | 252 |
| AT4G31060.1 | 253 | 254 |
| AT5G21960.1 | 255 | 256 |
| AT1G19210.1 | 257 | 258 |
| AT1G74930.1 | 259 | 260 |
| AT1G22810.1 | 261 | 262 |
| AT1G71520.1 | 263 | 264 |

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute. Furthermore, access to proprietary databases, has allowed the identification of novel nucleic acid and polypeptide sequences.

1.4 TPS, TPP and TPS-TPP Polypeptide

Sequences (full length, partial cDNAs, ESTs or genomic) related to TPS and TPP enzymes were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 272 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Table A4, A5 and A6 provide a list of nucleic acid and protein sequences of TPS and TPP enzymes and fusions of the same, respectively.

TABLE A4

Examples of TPS polynucleotides and polypeptides:

| Enzyme class | Name | Polynucleotide SEQ ID NO: | Polypeptide SEQ ID NO: |
|---|---|---|---|
| TPS | TPSportioninTPS-TPP-cloned2cloningaa | 272 | 273 |
| TPS | TPSportioninTPS-TPP | 274 | 275 |
| TPS | A.thaliana__AT1G16980.1#1__Class-I | 276 | 277 |
| TPS | A.thaliana__AT1G17000.1#1__Class-I | 278 | 279 |
| TPS | A.thaliana__AT1G78580.1#1__Class-I | 280 | 281 |
| TPS | A.thaliana__AT4G27550.1#1__Class-I | 282 | 283 |
| TPS | O.sativa__LOC__Os05g44210.1#1__Class-I | 284 | 285 |
| TPS | P.tremuloides__828543#1__Class-I | 286 | 287 |
| TPS | S.bicolor__Sb09g025790.1#1__Class-I | 288 | 289 |
| TPS | S.lepidophylla__U96736#1__Class-I | 290 | 291 |
| TPS | S.lycopersicum__EF151131#1__Class-I | 292 | 293 |
| TPS | T.aestivum__FJ167677#1__Class-I | 294 | 295 |
| TPS | E.coli__AAS99849.1__OtsA__BAC | 296 | 297 |

TABLE A5

Examples of TPP polynucleotides and polypeptides:

| Enzyme class | Name | Nucleotide SEQ ID NO: | Polypeptide SEQ ID NO: |
|---|---|---|---|
| TPP-classIII-B | TPPcloned-3cloningaa | 298 | 299 |
| TPP-classIII-B | A.thaliana__AT1G78090.1#1__Class-III-B | 300 | 301 |
| TPP-classIII-B | A.thaliana__AT1G22210.1#1__Class-III-B | 302 | 303 |
| TPP-classIII-B | A.thaliana__AT1G35910.1#1__Class-III-B | 304 | 305 |
| TPP-classIII-B | A.thaliana__AT2G22190.1#1__Class-III-B | 306 | 307 |
| TPP-classIII-B | A.thaliana__AT4G39770.1#1__Class-III-B | 308 | 309 |
| TPP-classIII-B | A.thaliana__AT5G10100.1#1__Class-III-B | 310 | 311 |
| TPP-classIII-B | A.thaliana__AT5G65140.1#1__Class-III-B | 312 | 313 |
| TPP-classIII-B | B.napus__BN06MC00179__43971274@178#1__Class-III-B | 314 | 315 |
| TPP-classIII-B | B.napus__BN06MC07104__42537476@7087#1__Class-III-B | 316 | 317 |
| TPP-classIII-B | B.napus__BN06MC14578__43887676@14532#1__Class-III-B | 318 | 319 |
| TPP-classIII-B | G.max__GM06MC01001__47125400@994#1__Class-III-B | 320 | 321 |
| TPP-classIII-B | G.max__GM06MC02336__48986355@2319#1__Class-III-B | 322 | 323 |
| TPP-classIII-B | G.max__GM06MC07245__50736990@7181#1__Class-III-B | 324 | 325 |
| TPP-classIII-B | H.vulgare__c62965763hv270303@10320#1__Class-III-B | 326 | 327 |
| TPP-classIII-B | O.sativa__LOC__Os02g51680.1#1__Class-III-B | 328 | 329 |
| TPP-classIII-B | O.sativa__LOC__Os03g26910.1#1__Class-III-B | 330 | 331 |
| TPP-classIII-B | O.sativa__LOC__Os07g43160.1#1__Class-III-B | 332 | 333 |
| TPP-classIII-B | O.sativa__LOC__Os08g31630.1#1__Class-III-B | 334 | 335 |
| TPP-classIII-B | O.sativa__LOC__Os09g20390.1#1__Class-III-B | 336 | 337 |
| TPP-classIII-B | P.patens__208578#1__Class-III-B | 338 | 339 |
| TPP-classIII-B | P.tremuloides__760807#1__Class-III-B | 340 | 341 |
| TPP-classIII-B | P.trichocarpa__EF146154#1__Class-III-B | 342 | 343 |
| TPP-classIII-B | T.aestivum__TA06MC06019__54656424@6005#1__Class-III-B | 344 | 345 |
| TPP-classIII-B | Z.mays__ZM07MC19692__BFb0134L02@19642#1__Class-III-B | 346 | 347 |
| TPP-classIII-B | Z.mays__ZM07MC23790__BFb0059J15@23724#1__Class-III-B | 348 | 349 |
| TPP-classIII-B | Z.mays__ZM07MC27487__BFb0200M10@27405#1__Class-III-B | 350 | 351 |
| TPP-classIII-B | Z.mays__ZM07MC27735__BFb0207C15@27651#1__Class-III-B | 352 | 353 |
| TPP-classIII-B | Z.mays__ZM07MC35169__BFb0383A11@35062#1__Class-III-B | 354 | 355 |
| TPP-classIII-B | E.coli__AAS99850.1__OTsB__BAC | | 356 |
| TPP-classIII-B | S.cerevisiae__NP__010359.1__Tps2p__FUNGI | | 357 |
| TPP-classIII-A | A.thaliana__AT4G12430.1#1__Class-III-A | 358 | 359 |
| TPP-classIII-A | A.thaliana__AT4G22590.1#1__Class-III-A | 360 | 361 |
| TPP-classIII-A | A.thaliana__AT5G51460.1#1__Class-III-A | 362 | 363 |
| TPP-classIII-A | G.max__GM06MC27748__sae81b02@27120#1__Class-III-A | 364 | 365 |
| TPP-classIII-A | O.sativa__LOC__Os02g44230.1#1__Class-III-A | 366 | 367 |
| TPP-classIII-A | O.sativa__LOC__Os04g46760.1#1__Class-III-A | 368 | 369 |
| TPP-classIII-A | O.sativa__LOC__Os07g30160.1#1__Class-III-A | 370 | 371 |
| TPP-classIII-A | O.sativa__LOC__Os10g40550.1#1__Class-III-A | 372 | 373 |
| TPP-classIII-A | P.tremuloides__570601#1__Class-III-A | 374 | 375 |
| TPP-classIII-A | P.tremuloides__837090#1__Class-III-A | 376 | 377 |
| TPP-classIII-A | T.aestivum__c54449998@14156#1__Class-III-A | 378 | 379 |
| TPP-classIII-A | Z.mays__ZM07MC26856__BFb0183M21@26776#1__Class-III-A | 380 | 381 |
| TPP-classIII-A | Z.mays__ZM07MC33344__BFb0308C14@33243#1__Class-III-A | 382 | 383 |
| TPP-classIII-A | Z.mays__ZM07MSbpsHQ__61987012.f01@48342#1__Class-III-A | 384 | 385 |
| TPP-classII | A.thaliana__AT1G06410.1#1__Class-II | 386 | 387 |
| TPP-classII | A.thaliana__AT1G23870.1#1__Class-II | 388 | 389 |

TABLE A5-continued

Examples of TPP polynucleotides and polypeptides:

| Enzyme class | Name | Nucleotide SEQ ID NO: | Polypeptide SEQ ID NO: |
|---|---|---|---|
| TPP-classII | A.thaliana_AT1G60140.1#1_Class-II | 390 | 391 |
| TPP-classII | A.thaliana_AT1G68020.1#1_Class-II | 392 | 393 |
| TPP-classII | A.thaliana_AT1G70290.1#1_Class-II | 394 | 395 |
| TPP-classII | A.thaliana_AT2G18700.1#1_Class-II | 396 | 397 |
| TPP-classII | A.thaliana_AT4G17770.1#1_Class-II | 398 | 399 |
| TPP-classII | G.biloba_AY884150#1_Class-II | 400 | 401 |
| TPP-classII | G.hirsutum_AY628139#1_Class-II | 402 | 403 |
| TPP-classII | O.sativa_LOC_Os01g53000.1#1_Class-II | 404 | 405 |
| TPP-classII | O.sativa_LOC_Os01g54560.1#1_Class-II | 406 | 407 |
| TPP-classII | O.sativa_LOC_Os02g54820.1#1_Class-II | 408 | 409 |
| TPP-classII | O.sativa_LOC_Os03g12360.1#1_Class-II | 410 | 411 |
| TPP-classII | O.sativa_LOC_Os05g44100.1#1_Class-II | 412 | 413 |
| TPP-classII | O.sativa_LOC_Os08g34580.1#1_Class-II | 414 | 415 |
| TPP-classII | O.sativa_LOC_Os09g20990.1#1_Class-II | 416 | 417 |
| TPP-classII | O.sativa_LOC_Os09g23350.1#1_Class-II | 418 | 419 |
| TPP-classII | P.patens_190874#1_Class-II | 420 | 421 |
| TPP-classII | P.tremuloides_561404#1_Class-II | 422 | 423 |
| TPP-classII | P.tremuloides_568670#1_Class-II | 424 | 425 |
| TPP-classII | P.tremuloides_757196#1_Class-II | 426 | 427 |
| TPP-classII | P.tremuloides_806458#1_Class-II | 428 | 429 |
| TPP-classII | S.lycopersicum_AB368491#1_Class-II | 430 | 431 |
| TPP-classII | Z.marina_EU399759#1_Class-II | 432 | 433 |
| TPP-classII | Z.mays_ZM07MC10175_62174622@10156#1_Class-II | 434 | 435 |
| TPP-classII | Z.mays_ZM07MC29609_BFb0010E24@29519#1_Class-II | 436 | 437 |
| TPP-classII | Z.mays_ZM07MC36251_BFb0274J14@36138#1_Class-II | 438 | 439 |

TABLE A6

Examples of TPS-TPP polynucleotides and polypeptides:

| Enzyme class | Name | Nucleotide SEQ ID NO: | Polypeptide SEQ ID NO: |
|---|---|---|---|
| Fusion TPS-TPP | A.thaliana_DNTPS1-TPPB | 440 | 441 |
| Fusion TPS-TPP | S.cerevisiae_TPS1/TPS2_fusion | 442 | 443 |
| Fusion TPS-TPP | S.cerevisiae_Chl.TPS1/TPS2_fusion | 444 | 445 |
| Fusion TPS-TPP | A.dehalogenans_YP_463663.1_BAC_Fusion | | 446 |
| Fusion TPS-TPP | B.vulgatus_YP_001300510.1_BAC_Fusion | | 447 |
| Fusion TPS-TPP | C.hutchinsonii_YP_677030.1_BAC_Fusion | | 448 |
| Fusion TPS-TPP | M.xanthus_YP_629451.1_BAC_Fusion | | 449 |
| Fusion TPS-TPP | P.distasoni_YP_001305229.1_BAC_Fusion | | 450 |
| Fusion TPS-TPP | A.fumigatus_XP_755036.1_FUNGI_Fusion | | 451 |
| Fusion TPS-TPP | A.terreus_XP_001217556.1_FUNGI_Fusion | | 452 |
| Fusion TPS-TPP | C.albicans_EAL02458.1_FUNGI_Fusion | | 453 |
| Fusion TPS-TPP | P.stipitis_XP_001385509.2_FUNGI_Fusion | | 454 |

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute. Furthermore, access to proprietary databases, has allowed the identification of novel nucleic acid and polypeptide sequences.

Example 2

Alignment of Sequences Related to the Polypeptide Sequences Used in Methods of the Invention 2.1 CLC-Like Polypeptides Alignment of polypeptide sequences was performed using the ClustalW 2.0 algorithm of progressive alignment (Thompson et al. (1997) Nucleic Acids Res 25:4876-4882; Chema et al. (2003). Nucleic Acids Res 31:3497-3500) with standard setting (slow alignment, similarity matrix: Gonnet, gap opening penalty 10, gap extension penalty: 0.2). Minor manual editing was done to further optimise the alignment. The CLC-like polypeptides are aligned in FIG. 2.

Figure 3:
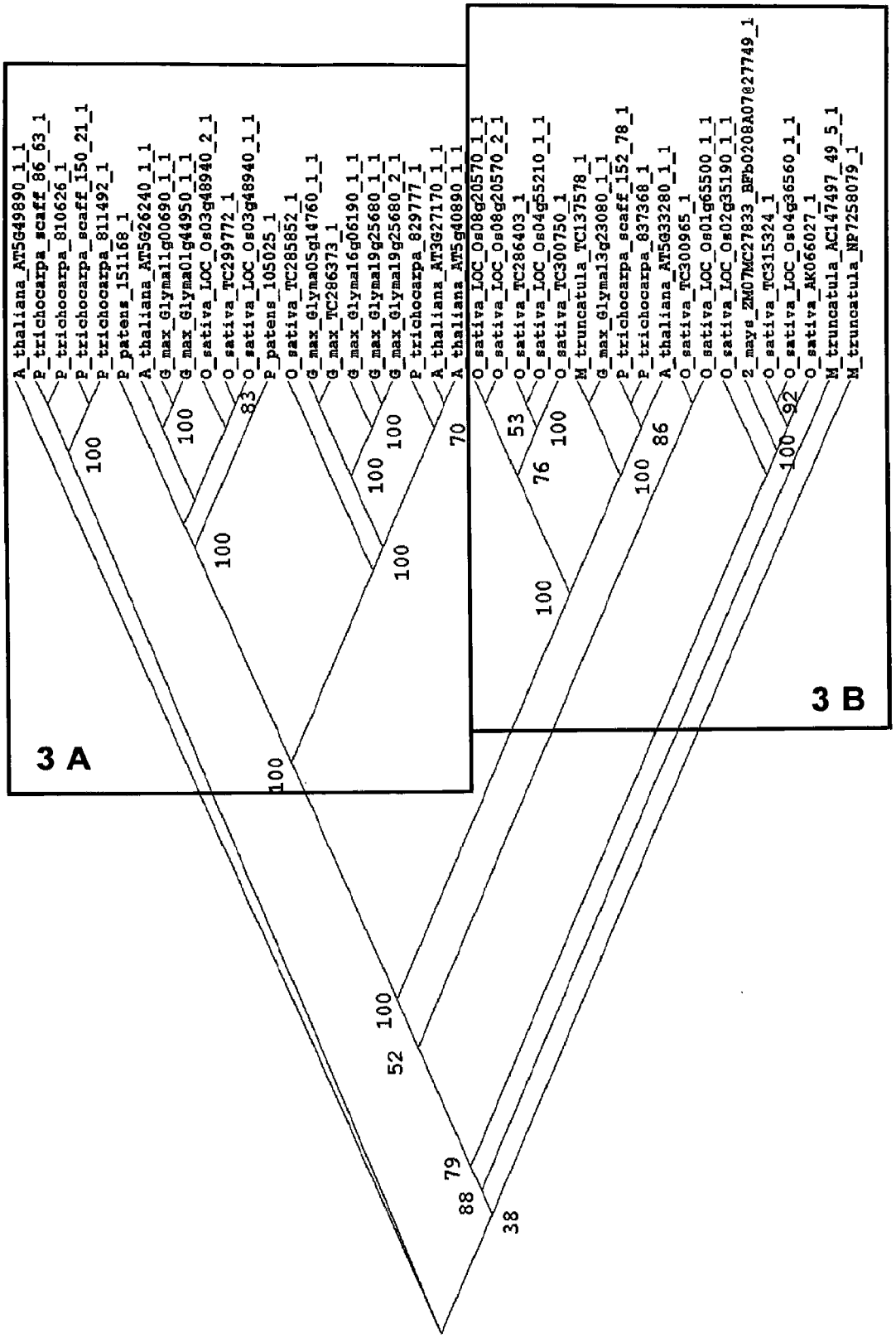
FIG. 3 shows phylogenetic tree of CLC-like polypeptides, SEQ ID NO: 2 is represented as O_sativa_TC285852
Figure 3:
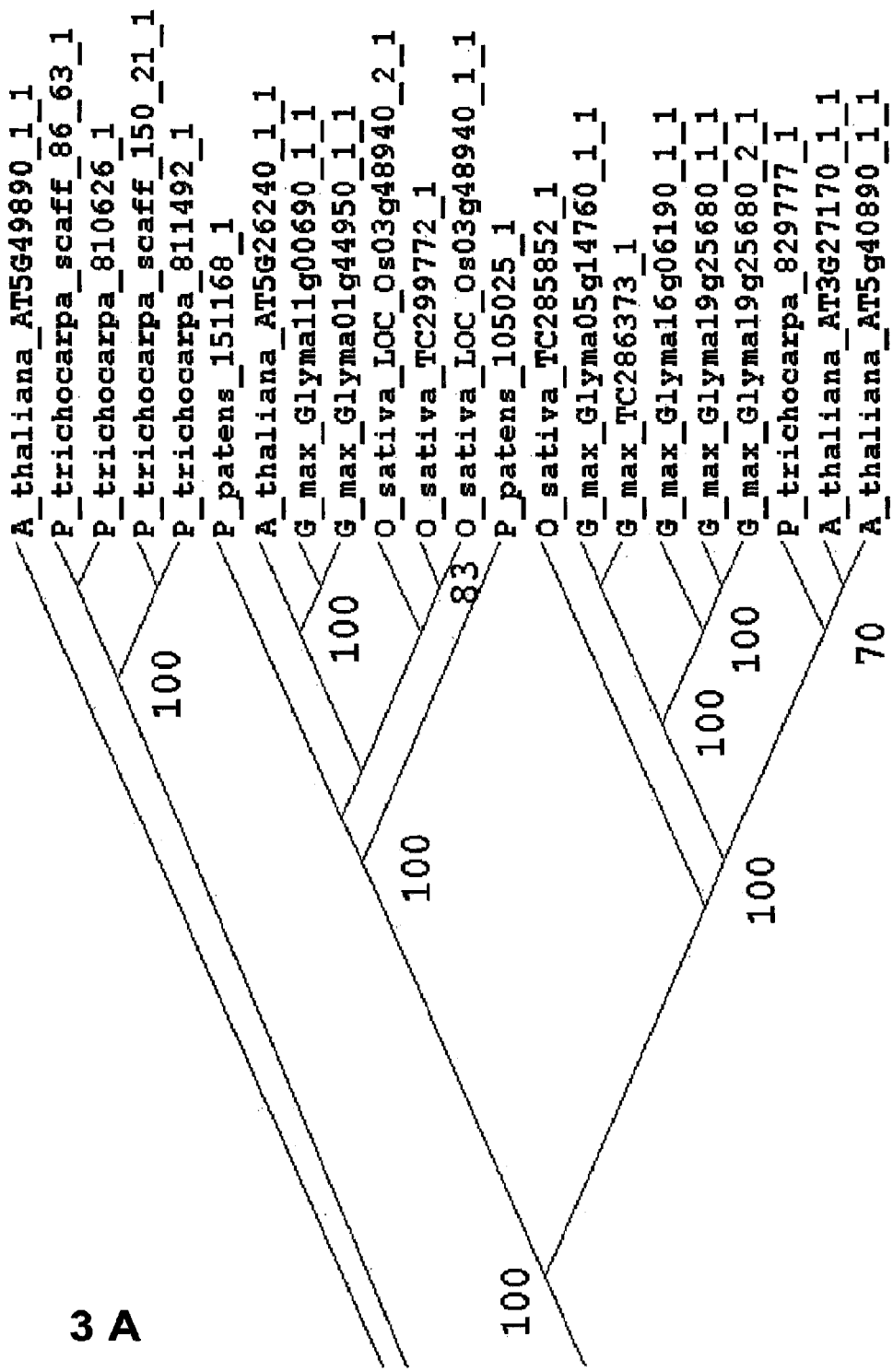
Figure 3:
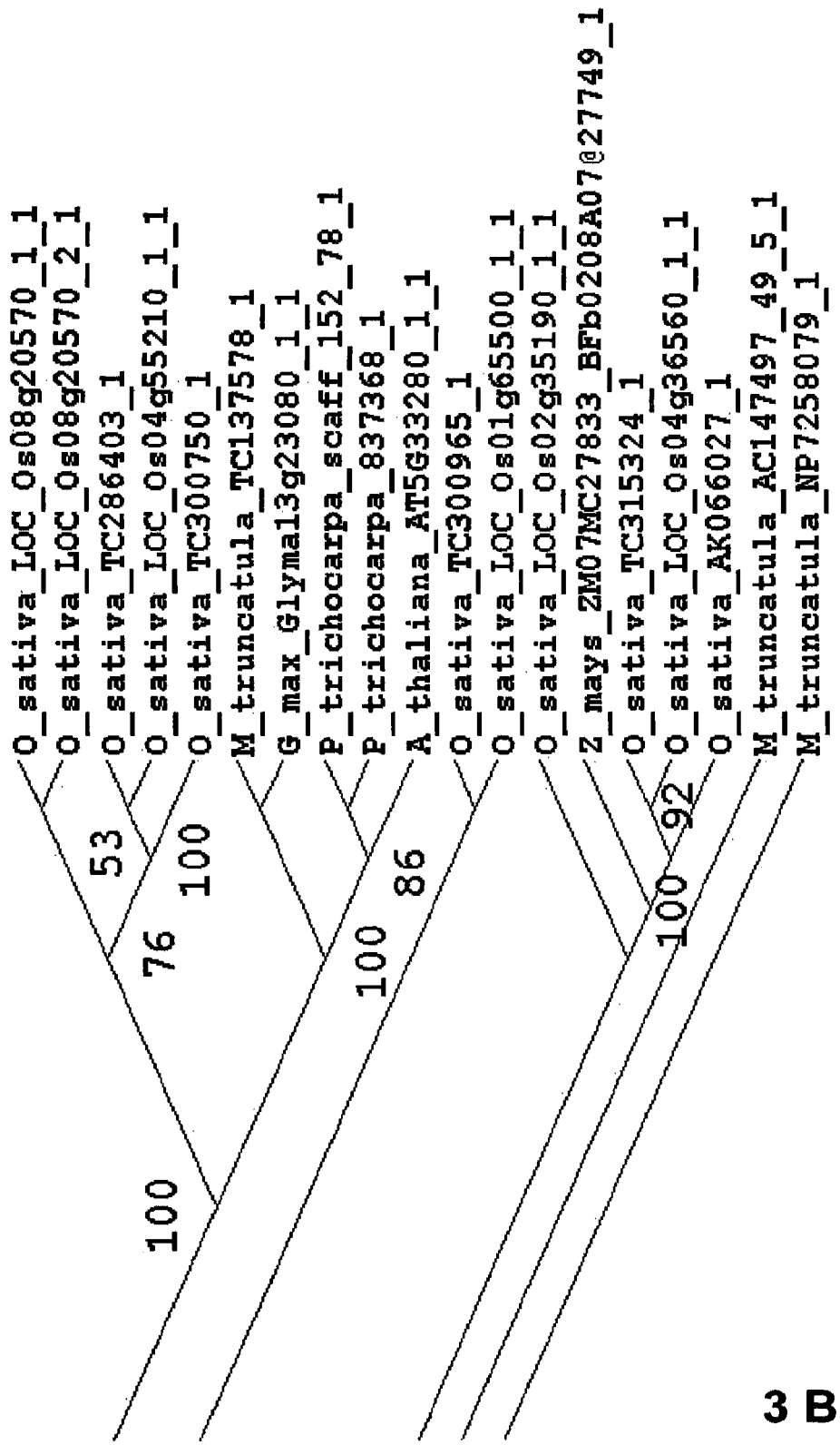

A phylogenetic tree of CLC-like polypeptides (FIG. 3) was constructed using MAFFT with standard settings (Katoh and Toh (2008) Briefings in Bioinformatics 9:286-298). Confidence for 100 bootstrap repetitions is indicated for major branching.

2.2 OsBURP-Like Polypeptides

Alignment of polypeptide sequences was performed using MAFFT with standard settings (Katoh and Toh (2008) Briefings in Bioinformatics 9:286-298). The OsBURP-like polypeptides are aligned in FIG. 6. MAFFT was also used to generate a phylogenetic tree and the cladogram (FIG. 7) was drawn using Dendroscope (Huson et al. (2007), BMC Bioinformatics 8(1):460). Confidence for 100 bootstrap repetitions is indicated for major branching.

2.3 AP2/ERF-Like Polypeptides

Alignment of polypeptide sequences was performed using the ClustalW 2.0 algorithm of progressive alignment (Thompson et al. (1997) Nucleic Acids Res 25:4876-4882; Chema et al. (2003); Nucleic Acids Res 31:3497-3500) with standard setting (slow alignment, similarity matrix: Gonnet, gap opening penalty 10, gap extension penalty: 0.2). Minor manual editing was done to further optimise the alignment. The AP2/ERF polypeptides are aligned in FIG. 9.

A phylogenetic tree of AP2/ERF polypeptides (FIG. 10) was constructed using a neighbour-joining clustering algorithm as provided in the AlignX programme from the Vector NTI (Invitrogen).

2.4 TPS, TPP and TPS-TPP Polypeptide

Alignment of polypeptide sequences is performed using the ClustalW 2.0 algorithm of progressive alignment (Thompson et al. (1997) Nucleic Acids Res 25:4876-4882; Chema et al. (2003). Nucleic Acids Res 31:3497-3500) with standard setting (slow alignment, similarity matrix: Gonnet (or Blosum 62 (as for example used in the Vector NTI package provided by Invitrogen), gap opening penalty 10, gap extension penalty: 0.2). Minor manual editing may be done to further optimise the alignment.

A phylogenetic tree of TPS, TPP and/or TPS-TPP polypeptides is constructed using a neighbour-joining clustering algorithm as provided in the AlignX programme from the Vector NTI (Invitrogen).

A phylogenetic tree of TPS and TPP polypeptides of *Arabidopsis thaliana* and *saccharomyces cerevise* origin is shown in FIG. 14.

Example 3

Calculation of Global Percentage Identity Between Polypeptide Sequences Useful in Performing the Methods of the Invention

3.1 CLC-Like Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were: Scoring matrix: Blosum62, First Gap: 12, Extending Gap: 2.

Results of the software analysis are shown in Table B1 for the global similarity and identity over the full length of the polypeptide sequences. The sequence identity (in %) between the CLC-like polypeptide sequences useful in performing the methods of the invention can be as low as 36% but is generally higher than 40% compared to SEQ ID NO: 2 (represented by Os_TC285852 on line 24).

TABLE B1

MatGAT results for global similarity and identity over the full length of the polypeptide sequences.

|    | | 1 | 2 | 3 | 4 | 5 | 6 | 7 | 8 | 9 | 10 | 11 | 12 | 13 | 14 | 15 |
|----|---|---|---|---|---|---|---|---|---|---|----|----|----|----|----|----|
| 1. | AT5g40890 | | 50.6 | 40.7 | 49.4 | 47.3 | 79.9 | 87.9 | 52.3 | 42.5 | 42.0 | 51.7 | 78.1 | 77.7 | 51.3 | 39.2 |
| 2. | Os01g65500 | 67.2 | | 42.1 | 55.9 | 51.6 | 50.2 | 50.1 | 55.2 | 43.6 | 43.1 | 56.3 | 49.6 | 50.9 | 54.9 | 40.1 |
| 3. | Os03g48940_1 | 58.2 | 57.9 | | 40.7 | 40.0 | 41.1 | 39.8 | 42.1 | 69.1 | 68.7 | 42.0 | 40.1 | 40.2 | 39.5 | 91.4 |
| 4. | Os04g55210 | 68.4 | 72.0 | 57.1 | | 60.7 | 50.1 | 49.9 | 64.6 | 43.3 | 43.7 | 63.7 | 48.5 | 49.6 | 62.1 | 39.3 |
| 5. | Os08g20570_2 | 66.3 | 67.1 | 57.8 | 74.4 | | 48.5 | 49.0 | 59.7 | 42.9 | 43.3 | 57.2 | 48.1 | 48.2 | 56.7 | 36.5 |
| 6. | Pt_829777 | 88.2 | 68.1 | 57.5 | 68.9 | 67.1 | | 81.9 | 52.9 | 43.1 | 43.1 | 51.1 | 80.1 | 80.9 | 51.6 | 40.0 |
| 7. | AT3G27170 | 92.7 | 67.1 | 57.6 | 68.4 | 67.1 | 89.8 | | 52.7 | 42.3 | 42.2 | 52.2 | 78.2 | 77.6 | 51.3 | 38.4 |
| 8. | AT5G33280 | 69.4 | 72.1 | 59.1 | 78.0 | 76.1 | 70.3 | 69.9 | | 43.9 | 43.9 | 72.9 | 51.5 | 51.2 | 71.0 | 38.6 |
| 9. | Gm01g44950 | 60.3 | 62.4 | 78.7 | 62.4 | 59.6 | 60.8 | 60.3 | 60.9 | | 98.6 | 45.4 | 41.8 | 42.7 | 43.7 | 65.1 |
| 10. | Gm11g00690 | 59.9 | 62.0 | 78.5 | 62.6 | 59.9 | 60.4 | 60.3 | 60.8 | 99.4 | | 45.1 | 41.8 | 42.7 | 43.6 | 64.6 |
| 11. | Gm13g23080 | 70.8 | 72.1 | 59.6 | 76.4 | 74.6 | 70.7 | 71.8 | 85.1 | 62.9 | 62.7 | | 51.0 | 50.5 | 80.4 | 38.5 |
| 12. | Gm19g25680_2 | 87.2 | 67.5 | 58.1 | 67.9 | 68.4 | 88.9 | 87.3 | 71.6 | 59.6 | 59.3 | 71.6 | | 86.2 | 51.0 | 38.9 |
| 13. | Gm_TC286373 | 87.6 | 69.5 | 58.1 | 69.6 | 67.6 | 90.3 | 88.3 | 71.3 | 61.4 | 61.4 | 71.3 | 91.3 | | 51.3 | 39.4 |
| 14. | Mt_TC137578 | 69.7 | 70.6 | 57.5 | 77.5 | 74.4 | 70.4 | 70.5 | 83.0 | 61.7 | 61.5 | 88.9 | 69.8 | 70.4 | | 37.3 |
| 15. | Os03g48940_2 | 55.2 | 55.0 | 93.2 | 54.6 | 54.1 | 54.8 | 54.5 | 55.6 | 74.3 | 74.2 | 55.6 | 55.7 | 55.2 | 54.3 | |
| 16. | Os08g20570_1 | 67.7 | 70.6 | 56.3 | 78.0 | 95.5 | 69.5 | 68.7 | 76.4 | 61.3 | 61.7 | 75.1 | 68.6 | 69.8 | 75.9 | 53.1 |
| 17. | Os_TC286403 | 68.1 | 71.4 | 56.9 | 99.0 | 73.9 | 69.1 | 68.0 | 77.8 | 63.0 | 62.8 | 75.8 | 68.1 | 69.1 | 77.1 | 54.5 |
| 18. | Os_TC300750 | 68.4 | 72.0 | 57.1 | 99.9 | 74.1 | 69.3 | 68.4 | 78.0 | 62.7 | 62.6 | 76.4 | 67.9 | 69.4 | 77.5 | 54.6 |
| 19. | Pt_837368 | 72.4 | 72.1 | 58.2 | 80.2 | 75.5 | 73.8 | 72.7 | 88.4 | 62.5 | 62.2 | 86.6 | 72.4 | 74.1 | 86.0 | 54.7 |
| 20. | AT5G26240 | 61.0 | 62.2 | 78.4 | 61.8 | 58.8 | 61.7 | 61.2 | 61.7 | 89.1 | 89.0 | 61.6 | 60.7 | 61.7 | 60.9 | 74.0 |
| 21. | Gm05g14760 | 82.6 | 65.7 | 55.6 | 65.5 | 65.7 | 84.8 | 83.1 | 68.5 | 57.8 | 57.8 | 68.8 | 87.9 | 94.5 | 66.9 | 52.6 |
| 22. | Gm16g06190 | 81.2 | 64.9 | 60.2 | 63.6 | 63.3 | 82.5 | 81.8 | 66.8 | 56.8 | 56.4 | 66.7 | 90.3 | 85.4 | 64.6 | 57.0 |
| 23. | Gm19g25680_1 | 88.6 | 68.6 | 58.1 | 69.2 | 68.7 | 90.3 | 88.7 | 71.7 | 60.4 | 60.2 | 72.1 | 98.6 | 92.7 | 70.9 | 55.6 |
| 24. | Os_TC285852 | 79.4 | 65.4 | 57.0 | 66.0 | 64.2 | 80.6 | 79.6 | 67.8 | 59.3 | 59.2 | 66.5 | 79.9 | 81.6 | 67.0 | 55.3 |
| 25. | Os_TC299772 | 59.0 | 61.6 | 88.9 | 61.8 | 58.7 | 59.8 | 60.0 | 60.1 | 86.2 | 86.1 | 60.7 | 60.0 | 60.6 | 60.0 | 84.5 |
| 26. | Os_TC300965 | 68.4 | 97.5 | 59.2 | 71.0 | 68.8 | 68.3 | 67.9 | 74.0 | 62.5 | 62.3 | 73.7 | 69.2 | 70.5 | 72.0 | 56.3 |
| 27. | Pp_105025 | 67.7 | 68.3 | 60.2 | 70.0 | 66.5 | 69.0 | 67.2 | 68.8 | 64.8 | 64.5 | 68.9 | 68.2 | 68.7 | 66.7 | 57.7 |
| 28. | Pp_151168 | 61.9 | 60.0 | 78.9 | 59.9 | 61.3 | 60.3 | 61.2 | 61.7 | 76.5 | 76.7 | 62.2 | 61.7 | 61.8 | 59.8 | 73.9 |
| 29. | Pt_scaff_152_78 | 70.8 | 70.1 | 59.0 | 77.7 | 74.0 | 72.4 | 71.2 | 86.5 | 61.0 | 61.0 | 85.2 | 71.6 | 72.4 | 83.2 | 55.2 |

|    | | 16 | 17 | 18 | 19 | 20 | 21 | 22 | 23 | 24 | 25 | 26 | 27 | 28 | 29 |
|----|---|----|----|----|----|----|----|----|----|----|----|----|----|----|----|
| 1. | AT5g40890 | 50.1 | 48.6 | 49.4 | 54.1 | 41.6 | 72.0 | 71.9 | 79.2 | 65.9 | 41.7 | 51.6 | 48.3 | 42.8 | 53.5 |
| 2. | Os01g65500 | 54.2 | 55.1 | 55.9 | 56.9 | 44.0 | 47.2 | 46.8 | 50.1 | 49.9 | 43.9 | 97.5 | 52.9 | 46.4 | 55.4 |

TABLE B1-continued

MatGAT results for global similarity and identity over the full length of the polypeptide sequences.

| | | | | | | | | | | | | | | |
|---|---|---|---|---|---|---|---|---|---|---|---|---|---|---|
| 3. Os03g48940__1 | 40.5 | 40.5 | 40.6 | 42.4 | 69.6 | 36.7 | 40.9 | 40.1 | 38.6 | 88.9 | 42.9 | 47.0 | 64.7 | 42.9 |
| 4. Os04g55210 | 63.3 | 98.9 | 99.8 | 67.7 | 42.8 | 46.0 | 44.8 | 49.2 | 49.8 | 43.0 | 55.5 | 53.3 | 43.1 | 64.9 |
| 5. Os08g20570__2 | 95.5 | 59.9 | 60.6 | 60.2 | 41.7 | 44.9 | 42.8 | 48.9 | 46.5 | 41.6 | 52.7 | 47.4 | 45.3 | 57.4 |
| 6. Pt__829777 | 51.2 | 49.6 | 50.2 | 54.7 | 42.6 | 75.5 | 74.0 | 81.3 | 68.5 | 42.5 | 51.1 | 48.5 | 43.2 | 53.9 |
| 7. AT3G27170 | 51.2 | 49.0 | 49.9 | 54.8 | 41.7 | 72.4 | 71.7 | 79.2 | 65.5 | 41.5 | 51.2 | 48.2 | 43.2 | 53.9 |
| 8. AT5G33280 | 62.6 | 63.7 | 64.6 | 77.9 | 43.7 | 47.4 | 46.9 | 52.1 | 49.6 | 43.1 | 56.7 | 49.7 | 44.2 | 74.8 |
| 9. Gm01g44950 | 43.7 | 43.3 | 43.3 | 45.5 | 81.9 | 39.5 | 38.4 | 41.9 | 40.7 | 74.7 | 45.0 | 48.2 | 65.5 | 45.3 |
| 10. Gm11g00690 | 44.1 | 43.6 | 43.6 | 45.8 | 81.2 | 39.5 | 38.3 | 41.9 | 40.6 | 74.2 | 44.6 | 48.1 | 65.5 | 45.0 |
| 11. Gm13g23080 | 60.2 | 62.5 | 63.7 | 76.3 | 45.2 | 47.1 | 46.3 | 51.8 | 47.9 | 43.5 | 57.7 | 50.8 | 46.0 | 74.0 |
| 12. Gm19g25680__2 | 50.2 | 48.1 | 48.5 | 53.7 | 42.0 | 80.5 | 85.3 | 98.6 | 65.8 | 41.6 | 50.8 | 49.3 | 43.4 | 52.9 |
| 13. Gm__TC286373 | 50.6 | 49.0 | 49.8 | 54.2 | 41.7 | 94.3 | 79.4 | 87.2 | 67.5 | 41.6 | 51.9 | 49.0 | 42.6 | 53.7 |
| 14. Mt__TC137578 | 59.6 | 61.1 | 62.1 | 75.6 | 43.3 | 47.7 | 45.5 | 51.6 | 48.4 | 41.7 | 56.0 | 48.3 | 43.8 | 72.6 |
| 15. Os03g48940__2 | 37.8 | 38.6 | 38.8 | 39.3 | 65.5 | 35.9 | 39.9 | 39.1 | 38.3 | 84.2 | 40.9 | 44.8 | 59.8 | 39.4 |
| 16. Os08g20570__1 | | 62.4 | 63.2 | 63.2 | 42.6 | 47.3 | 45.3 | 51.0 | 49.0 | 42.8 | 55.5 | 50.0 | 44.0 | 60.4 |
| 17. Os__TC286403 | 77.6 | | 98.5 | 66.8 | 42.7 | 45.3 | 44.0 | 48.4 | 49.0 | 42.9 | 54.8 | 53.3 | 43.1 | 64.0 |
| 18. Os__TC300750 | 77.7 | 98.8 | | 67.7 | 42.4 | 46.0 | 44.8 | 49.2 | 49.8 | 43.0 | 55.5 | 53.3 | 42.8 | 64.9 |
| 19. Pt__837368 | 77.0 | 79.8 | 80.2 | | 44.9 | 50.4 | 48.8 | 54.1 | 51.0 | 43.6 | 59.2 | 52.2 | 44.8 | 94.8 |
| 20. AT5G26240 | 60.6 | 62.0 | 61.1 | 62.5 | | 38.5 | 38.8 | 42.2 | 40.9 | 75.2 | 45.1 | 50.2 | 64.1 | 44.5 |
| 21. Gm05g14760 | 66.2 | 65.1 | 65.5 | 69.7 | 58.1 | | 74.0 | 81.6 | 62.9 | 38.4 | 48.1 | 45.5 | 39.2 | 50.0 |
| 22. Gm16g06190 | 63.8 | 63.2 | 63.6 | 67.9 | 58.0 | 82.4 | | 86.6 | 61.3 | 38.2 | 47.3 | 45.2 | 40.1 | 49.4 |
| 23. Gm19g25680__1 | 69.7 | 68.8 | 69.2 | 73.7 | 61.7 | 88.4 | 90.4 | | 66.5 | 41.6 | 51.3 | 49.6 | 43.3 | 53.5 |
| 24. Os__TC285852 | 66.2 | 65.5 | 66.0 | 69.2 | 60.4 | 76.5 | 74.6 | 81.0 | | 39.9 | 50.5 | 47.0 | 40.6 | 50.5 |
| 25. Os__TC299772 | 60.3 | 61.4 | 61.8 | 60.2 | 84.7 | 56.8 | 56.7 | 60.7 | 60.1 | | 44.7 | 49.3 | 63.9 | 43.4 |
| 26. Os__TC300965 | 70.6 | 70.4 | 71.0 | 74.3 | 62.1 | 67.5 | 66.2 | 70.4 | 66.7 | 61.3 | | 53.8 | 47.6 | 57.7 |
| 27. Pp__105025 | 69.7 | 70.2 | 69.9 | 69.5 | 65.8 | 64.7 | 63.0 | 68.9 | 64.2 | 64.4 | 68.3 | | 48.9 | 51.3 |
| 28. Pp__151168 | 59.9 | 60.2 | 59.7 | 60.8 | 76.1 | 59.4 | 60.4 | 61.6 | 58.0 | 75.0 | 61.6 | 63.4 | | 45.1 |
| 29. Pt__scaff__152__78 | 74.6 | 77.3 | 77.7 | 95.5 | 61.9 | 69.5 | 68.4 | 72.2 | 68.2 | 59.1 | 72.4 | 67.8 | 61.0 | |

3.2 OsBURP-Like Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were: Scoring matrix: Blosum62, First Gap: 12, Extending Gap: 2.

Results of the software analysis are shown in Table B2 for the global similarity and identity over the full length of the polypeptide sequences. The sequence identity (in %) between the OsBURP-like polypeptide sequences useful in performing the methods of the invention is generally higher than 30% compared to SEQ ID NO: 95.

TABLE B2

MatGAT results for global similarity and identity over the full length of the polypeptide sequences.

| | 1 | 2 | 3 | 4 | 5 | 6 | 7 | 8 | 9 | 10 | 11 | 12 |
|---|---|---|---|---|---|---|---|---|---|---|---|---|
| 1. Os__BURP__dist__OsBURP02 | | 77.7 | 73.1 | 64.7 | 71.8 | 34.1 | 16.9 | 28.7 | 30.2 | 20.4 | 33.7 | 35.5 |
| 2. OsBURP07 | 81.2 | | 66.2 | 66.8 | 75.4 | 34.8 | 16 | 29.6 | 30.2 | 20.1 | 33.8 | 36.7 |
| 3. OsBURP01 | 79.4 | 74.4 | | 57.4 | 57.7 | 27.6 | 13.6 | 26.9 | 27.8 | 17.6 | 28.9 | 31.9 |
| 4. OsBURP08 | 75.8 | 74.4 | 66.8 | | 62.3 | 31.2 | 16.4 | 28.5 | 29.9 | 20.8 | 30.6 | 33.8 |
| 5. OsBURP06 | 73.9 | 82.6 | 64.8 | 69.2 | | 30.4 | 15 | 27.4 | 28.8 | 19.1 | 30.6 | 32.2 |
| 6. Triticum__aestivum__AJ575664 | 47.2 | 46.4 | 40.1 | 45.3 | 41.7 | | 20.5 | 27 | 28.1 | 23.1 | 31.4 | 33 |
| 7. Hordeum__vulgare__AK252727 | 22.6 | 21.8 | 20.2 | 22.9 | 20.4 | 27.4 | | 20 | 21 | 24.1 | 22.8 | 20.5 |
| 8. AtRD22__AT5G25610.1 | 42.1 | 40.6 | 36 | 41.6 | 37.5 | 46.7 | 31.3 | | 86.5 | 27.4 | 50.1 | 49.6 |
| 9. Brassica__napus__AY293830 | 42.4 | 40.6 | 36.7 | 42.1 | 37.2 | 46.5 | 31.1 | 91.3 | | 26.7 | 50.3 | 48.9 |
| 10. OsBURP17 | 28 | 27.2 | 24.2 | 28.2 | 24.7 | 34.2 | 41.9 | 38.5 | 37.7 | | 34.5 | 32.9 |
| 11. OsBURP03 | 42.4 | 42.4 | 37.8 | 41.3 | 38.9 | 45.5 | 34.3 | 63.2 | 62.9 | 42.7 | | 70.4 |
| 12. Zea__mays__BT036729 | 47.7 | 47.7 | 42.9 | 46.1 | 42.4 | 49.9 | 30.8 | 61.7 | 62.3 | 42.8 | 77.2 | |
| 13. OsBURP05 | 43.2 | 42.5 | 38.7 | 41.2 | 38.7 | 45.7 | 32.6 | 50.8 | 51 | 46.3 | 54.8 | 58 |
| 14. Medicago__truncatula__BT051769 | 53.5 | 52.6 | 46.2 | 54.2 | 49.5 | 50.6 | 27.6 | 59.7 | 59.4 | 35.5 | 54.8 | 60 |
| 15. P. trichocarpa__561796 | 44.4 | 43.1 | 37.7 | 45.1 | 41.1 | 50.6 | 32.8 | 71.3 | 73.1 | 41.9 | 69.2 | 64.8 |
| 16. Vitisvinifera__LOC100249127 | 54.2 | 52 | 45.5 | 52 | 48 | 48.1 | 27.9 | 56.6 | 58.4 | 33.3 | 49.2 | 55.2 |
| 17. Bruguiera__gymnorhiza__AB062746 | 49.7 | 48.5 | 44.3 | 50 | 47.3 | 51.1 | 28.8 | 61.7 | 63.8 | 36.5 | 55.9 | 61.3 |
| 18. Mt__BURP__dist | 51.1 | 50.8 | 45.6 | 54.4 | 47.9 | 44.8 | 26.1 | 52.6 | 54 | 32.5 | 45.9 | 50.7 |
| 19. Gossypium__arboreum__AY641991 | 46.5 | 45.2 | 39.6 | 45.2 | 44.1 | 49.7 | 30.9 | 73.2 | 74.7 | 39 | 65.7 | 68.9 |
| 20. Gossypium__arboreum__AY641990 | 51 | 49.9 | 43.9 | 50.4 | 48.4 | 47.8 | 27.2 | 65.3 | 66.4 | 35.4 | 56.2 | 61.6 |
| 21. Gossypium__hirsutum__AY072821 | 52.2 | 51 | 44.8 | 51.6 | 49.6 | 48.6 | 27.9 | 66.1 | 67.2 | 36.1 | 57.8 | 62.9 |
| 22. Gossypium__hirsutum__AY343972 | 51 | 49.9 | 44.2 | 50.4 | 49 | 47.8 | 27.6 | 65.8 | 66.9 | 35.4 | 56.2 | 62.1 |
| 23. Glycine__max__EU679375 | 48.5 | 46.9 | 40.9 | 48.2 | 44.4 | 53.4 | 31.3 | 68.4 | 69.8 | 40 | 60.1 | 66.9 |

TABLE B2-continued

MatGAT results for global similarity and identity over the full length of the polypeptide sequences.

| | | 13 | 14 | 15 | 16 | 17 | 18 | 19 | 20 | 21 | 22 | 23 |
|---|---|---|---|---|---|---|---|---|---|---|---|---|
| 1. | Os__BURP__dist__OsBURP02 | 33.3 | 33.9 | 32.4 | 38.3 | 35.3 | 32.6 | 32.1 | 35.1 | 36.2 | 35.1 | 33.2 |
| 2. | OsBURP07 | 33.2 | 35 | 31.8 | 38.5 | 33.1 | 33.3 | 30.4 | 33.8 | 34.4 | 33.8 | 32.6 |
| 3. | OsBURP01 | 28.6 | 30.2 | 27.3 | 33 | 30.4 | 29 | 27.4 | 29.5 | 29.8 | 29.5 | 28.3 |
| 4. | OsBURP08 | 31.4 | 34.2 | 30.1 | 34.2 | 34.9 | 35.7 | 30.4 | 34 | 34.3 | 34.3 | 32.1 |
| 5. | OsBURP06 | 29.8 | 33 | 31.2 | 35.4 | 32.5 | 31.4 | 30.6 | 33.8 | 34.4 | 34.1 | 30.9 |
| 6. | Triticum__aestivum__AJ575664 | 31 | 32.1 | 32.3 | 32.1 | 31.3 | 26.5 | 31.7 | 31.7 | 32.3 | 31.7 | 31.4 |
| 7. | Hordeum__vulgare__AK252727 | 20.7 | 17.2 | 21 | 18.3 | 19.5 | 16.8 | 21.1 | 18.9 | 19.4 | 19 | 20.6 |
| 8. | AtRD22__AT5G25610.1 | 33.7 | 44.5 | 59.1 | 43.8 | 50.1 | 39 | 58 | 52.3 | 52.8 | 51.9 | 54.3 |
| 9. | Brassica__napus__AY293830 | 33.6 | 46.2 | 61.1 | 45.8 | 51.5 | 38.8 | 60.5 | 54 | 54.5 | 53.7 | 55.4 |
| 10. | OsBURP17 | 37.6 | 24.9 | 31.4 | 23.2 | 25.6 | 23.1 | 27.7 | 25.3 | 25.9 | 25.3 | 28.5 |
| 11. | OsBURP03 | 40.5 | 41 | 58.6 | 38.2 | 43.8 | 33.2 | 51.6 | 43.6 | 44.7 | 43.6 | 48.7 |
| 12. | Zea__mays__BT036729 | 42 | 46 | 53.3 | 41.5 | 48.3 | 36.5 | 51.3 | 46.5 | 47.6 | 46.8 | 53.6 |
| 13. | OsBURP05 | | 35.1 | 34.5 | 33.3 | 34.5 | 31.5 | 35.3 | 34.5 | 35.3 | 34.5 | 35.4 |
| 14. | Medicago__truncatula__BT051769 | 52.8 | | 50.5 | 56.1 | 55.1 | 60.9 | 51.6 | 55.6 | 56.7 | 56.1 | 63 |
| 15. | P. trichocarpa__561796 | 52.9 | 64.8 | | 52.2 | 61.6 | 43.8 | 66.2 | 59.9 | 61.3 | 59.6 | 60.1 |
| 16. | Vitisvinifera__LOC100249127 | 47 | 75.7 | 63.6 | | 54.7 | 50.9 | 51.1 | 57.3 | 58.2 | 57 | 52.9 |
| 17. | Bruguiera__gymnorhiza__AB062746 | 50.5 | 74.4 | 71.8 | 71.7 | | 48.8 | 59.9 | 63.8 | 65.6 | 64.1 | 58.3 |
| 18. | Mt_BURP_dist | 46.5 | 73.2 | 56.9 | 67.4 | 65.5 | | 42.9 | 46.3 | 47.8 | 46.3 | 54.2 |
| 19. | Gossypium__arboreum__AY641991 | 52.8 | 66.2 | 78.3 | 64.4 | 73.9 | 59 | | 83.2 | 85.4 | 83.2 | 62.6 |
| 20. | Gossypium__arboreum__AY641990 | 49 | 72.8 | 70.8 | 71 | 80.1 | 64.8 | 85.4 | | 97 | 98.2 | 59.5 |
| 21. | Gossypium__hirsutum__AY072821 | 50.3 | 74.3 | 71.8 | 72.2 | 81.3 | 65.7 | 87.2 | 97.6 | | 97 | 61.4 |
| 22. | Gossypium__hirsutum__AY343972 | 49.5 | 73.4 | 70.8 | 71.3 | 80.1 | 65.1 | 85.6 | 98.5 | 97.9 | | 59.5 |
| 23. | Glycine__max__EU679375 | 52.3 | 75.5 | 74.8 | 66.8 | 70.3 | 67.3 | 75.8 | 71.4 | 73 | 71.7 | |

3.3 AP2/ERF-Like Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were: Scoring matrix: Blosum62, First Gap: 12, Extending Gap: 2.

Results of the software analysis are shown in Table B3 for the global similarity and identity over the full length of the polypeptide sequences. The sequence identity (in %) between the AP2/ERF polypeptide sequences useful in performing the methods of the invention is generally higher than 60% compared to SEQ ID NO: 160.

The following annotation is applied in Table B3: 1. G_max_Glyma17g18580__1; 2. H_annuus_TC30931; 3. S_lycopersicum_TC196769_CDS__; 4. A_thaliana_AT4G06746__1; 5. G_max_Glyma05g19050__1; 6. A_thaliana_AT1G46768__1; 7. A_thaliana_AT3G50260__1; 8. H_annuus_TC31134; 9. P_trichocarpa__826816; 10. H_annuus_HAO4MC01018__66822928__1017; 11. P_trichocarpa__644094; 12. G_max_TC258747; 13. B_napus_TC67876; 14. S_lycopersicum_TC213116; 15. H_annuus_TC34117; 16. G_max_Glyma01g39540__1; 17. B_napus_TC79173; 18. M_truncatula_TC125274; 19. P_trichocarpa_TC111318; 20. G_max_Glyma14g09320__1; 21. G_max_TC266306; 22. A_thaliana_AT2G23340__1; 23. B_napus_TC89313; 24. B_napus_BN06MCO2259__42032738__2254; 25. B_napus_TC73559; 26. T_aestivum_TC277269; 27. M_truncatula_TC129893_CDS__; 28. MtAp2ERF_CDS__; 29. M_truncatula_TC117996_CDS__; 30. P_trichocarpa_TC91546; 31. A_thaliana_AT5G67190__1; 32. O_sativa_Os06g0166400; 33. P_trichocarpa_CV260432; 34. B_napus_TC68928; 35. B_napus_TC86323; 36. A_thaliana_AT4G36900__1_CDS__; 37. B_napus_TC72792; 38. Z_mays_TA32842__4577999; 39. O_sativa_LOC_Os04g55520__1; 40. T_aestivum_TC314990; 41. T_aestivum_TC277211; 42. TraitMillCDS__; 43. O_sativa_TC312964_CDS__.

TABLE B3

MatGAT results for global similarity and identity over the full length of the polypeptide sequences.

| | 1 | 2 | 3 | 4 | 5 | 6 | 7 | 8 | 9 | 10 | 11 | 12 |
|---|---|---|---|---|---|---|---|---|---|---|---|---|
| 1 | | 55.9 | 56.9 | 52.4 | 89.4 | 52.2 | 56.3 | 57.1 | 57.1 | 60.0 | 57.0 | 52.0 |
| 2 | 70.5 | | 61.7 | 48.2 | 54.7 | 50.6 | 52.2 | 72.2 | 58.2 | 53.0 | 58.2 | 52.4 |
| 3 | 72.5 | 71.8 | | 47.7 | 55.2 | 53.0 | 53.2 | 65.0 | 60.9 | 57.2 | 62.4 | 59.4 |
| 4 | 64.0 | 61.3 | 62.7 | | 51.8 | 49.4 | 46.6 | 50.3 | 51.9 | 50.3 | 49.1 | 48.5 |
| 5 | 93.3 | 71.3 | 71.3 | 63.3 | | 55.9 | 57.1 | 55.7 | 56.0 | 59.5 | 56.0 | 53.8 |
| 6 | 66.0 | 61.4 | 69.9 | 68.0 | 67.3 | | 44.1 | 49.4 | 53.9 | 48.5 | 53.7 | 52.1 |
| 7 | 69.3 | 68.0 | 70.6 | 62.7 | 69.9 | 62.1 | | 51.3 | 52.4 | 55.8 | 48.0 | 48.3 |
| 8 | 69.9 | 82.4 | 73.9 | 66.0 | 68.6 | 65.4 | 66.7 | | 57.1 | 54.4 | 58.3 | 53.5 |
| 9 | 71.0 | 73.5 | 79.4 | 61.9 | 71.0 | 69.0 | 68.4 | 71.0 | | 54.5 | 82.3 | 63.1 |
| 10 | 68.2 | 67.5 | 66.9 | 63.1 | 67.5 | 64.3 | 67.5 | 63.7 | 71.3 | | 54.5 | 55.8 |

TABLE B3-continued

MatGAT results for global similarity and identity over the full length of the polypeptide sequences.

| 11 | 70.3 | 71.5 | 78.5 | 60.1 | 69.6 | 64.6 | 66.5 | 69.6 | 89.9 | 69.6 |      | 60.7 |
|----|------|------|------|------|------|------|------|------|------|------|------|------|
| 12 | 70.6 | 64.4 | 75.6 | 60.0 | 68.8 | 66.3 | 67.5 | 68.1 | 80.6 | 70.6 | 80.0 |      |
| 13 | 67.3 | 64.2 | 66.0 | 59.9 | 65.4 | 58.0 | 83.3 | 63.6 | 68.5 | 64.8 | 67.9 | 64.2 |
| 14 | 66.3 | 65.1 | 66.3 | 57.8 | 67.5 | 56.6 | 66.3 | 65.7 | 68.1 | 75.3 | 69.9 | 68.1 |
| 15 | 68.9 | 63.5 | 64.7 | 59.9 | 67.7 | 59.9 | 63.5 | 64.7 | 67.1 | 77.2 | 68.9 | 67.7 |
| 16 | 74.4 | 66.1 | 67.3 | 60.7 | 73.8 | 62.5 | 69.6 | 66.7 | 66.1 | 66.7 | 65.5 | 67.9 |
| 17 | 67.5 | 66.9 | 62.1 | 58.6 | 62.7 | 58.0 | 69.8 | 67.5 | 65.1 | 66.9 | 62.7 | 64.5 |
| 18 | 60.5 | 61.0 | 66.3 | 59.9 | 61.0 | 64.5 | 60.5 | 61.6 | 70.3 | 63.4 | 68.6 | 73.8 |
| 19 | 67.1 | 59.0 | 66.5 | 63.6 | 65.9 | 57.8 | 68.8 | 60.1 | 63.0 | 63.0 | 64.7 | 68.2 |
| 20 | 63.8 | 62.1 | 67.2 | 61.5 | 63.2 | 67.8 | 61.5 | 62.1 | 75.9 | 62.1 | 70.7 | 79.3 |
| 21 | 62.6 | 61.5 | 67.8 | 60.3 | 60.9 | 65.5 | 60.9 | 62.1 | 71.8 | 61.5 | 67.8 | 77.6 |
| 22 | 63.1 | 61.9 | 60.8 | 59.1 | 61.4 | 54.0 | 69.3 | 63.6 | 63.1 | 64.2 | 64.8 | 61.4 |
| 23 | 64.2 | 63.6 | 60.2 | 56.8 | 60.8 | 54.5 | 67.6 | 66.5 | 63.6 | 65.9 | 60.8 | 61.9 |
| 24 | 62.6 | 57.5 | 63.1 | 54.2 | 62.6 | 55.3 | 70.4 | 62.0 | 63.7 | 63.7 | 63.7 | 64.8 |
| 25 | 62.0 | 57.5 | 63.1 | 53.6 | 63.1 | 55.3 | 70.9 | 60.3 | 63.1 | 63.7 | 63.7 | 64.2 |
| 26 | 60.3 | 57.0 | 59.8 | 57.0 | 59.2 | 58.7 | 57.5 | 59.2 | 59.8 | 59.2 | 60.9 | 57.5 |
| 27 | 58.3 | 58.3 | 63.9 | 56.1 | 56.7 | 60.6 | 58.9 | 56.1 | 65.6 | 60.6 | 66.7 | 71.7 |
| 28 | 66.5 | 59.3 | 64.8 | 56.0 | 67.0 | 57.7 | 63.2 | 58.8 | 61.5 | 62.1 | 63.2 | 64.8 |
| 29 | 66.5 | 59.3 | 64.8 | 56.0 | 67.0 | 57.7 | 63.2 | 58.8 | 61.5 | 62.1 | 63.2 | 64.8 |
| 30 | 67.0 | 57.7 | 64.8 | 59.3 | 64.8 | 56.0 | 66.5 | 59.9 | 62.1 | 62.1 | 62.6 | 65.4 |
| 31 | 63.0 | 59.8 | 62.5 | 53.8 | 60.9 | 54.3 | 70.7 | 58.7 | 65.8 | 62.5 | 63.0 | 62.0 |
| 32 | 56.5 | 58.7 | 56.0 | 55.4 | 56.0 | 59.2 | 56.0 | 58.7 | 58.7 | 59.8 | 58.2 | 53.8 |
| 33 | 65.8 | 56.7 | 63.6 | 57.2 | 64.7 | 56.7 | 63.1 | 57.8 | 60.4 | 62.0 | 60.4 | 65.2 |
| 34 | 61.7 | 58.0 | 61.2 | 51.1 | 61.2 | 53.2 | 69.1 | 63.3 | 63.8 | 61.2 | 61.7 | 62.2 |
| 35 | 56.3 | 59.4 | 57.8 | 51.6 | 57.8 | 52.6 | 60.4 | 56.3 | 59.4 | 58.9 | 58.9 | 57.8 |
| 36 | 56.1 | 60.2 | 56.1 | 53.6 | 54.6 | 53.6 | 59.2 | 58.2 | 60.2 | 55.6 | 57.7 | 56.1 |
| 37 | 54.8 | 57.4 | 53.8 | 50.8 | 53.8 | 52.3 | 59.4 | 55.3 | 57.9 | 55.3 | 57.4 | 56.9 |
| 38 | 52.1 | 53.4 | 51.1 | 48.9 | 53.0 | 47.9 | 49.8 | 53.4 | 52.5 | 50.7 | 52.5 | 49.8 |
| 39 | 49.4 | 49.8 | 49.4 | 43.8 | 49.4 | 44.2 | 46.8 | 48.5 | 51.1 | 47.6 | 50.2 | 50.2 |
| 40 | 47.3 | 49.4 | 46.9 | 43.9 | 46.4 | 45.2 | 49.4 | 48.1 | 51.0 | 49.4 | 49.4 | 47.7 |
| 41 | 46.9 | 47.7 | 48.1 | 43.6 | 46.9 | 42.8 | 47.7 | 47.3 | 49.4 | 48.1 | 48.1 | 46.5 |
| 42 | 42.7 | 43.5 | 42.7 | 45.6 | 41.5 | 45.2 | 42.3 | 45.2 | 45.6 | 45.6 | 46.0 | 42.7 |
| 43 | 34.3 | 35.6 | 34.6 | 35.9 | 33.3 | 36.2 | 34.3 | 36.2 | 38.1 | 37.5 | 37.1 | 35.2 |

|    | 13   | 14   | 15   | 16   | 17   | 18   | 19   | 20   | 21   | 22   | 23   | 24   |
|----|------|------|------|------|------|------|------|------|------|------|------|------|
| 1  | 55.2 | 55.9 | 54.1 | 67.5 | 57.6 | 50.6 | 55.6 | 50.6 | 48.9 | 54.5 | 55.1 | 51.6 |
| 2  | 53.0 | 53.5 | 50.6 | 54.8 | 55.2 | 47.2 | 48.0 | 46.4 | 47.3 | 54.0 | 53.1 | 47.3 |
| 3  | 50.3 | 56.6 | 54.7 | 55.6 | 50.9 | 52.2 | 52.3 | 50.3 | 51.9 | 48.6 | 50.0 | 48.6 |
| 4  | 46.0 | 48.3 | 48.0 | 50.0 | 48.1 | 50.6 | 49.5 | 48.3 | 48.9 | 49.2 | 48.6 | 40.1 |
| 5  | 56.4 | 55.8 | 55.2 | 65.9 | 57.6 | 51.7 | 56.4 | 51.7 | 48.6 | 54.5 | 55.7 | 52.9 |
| 6  | 43.2 | 45.4 | 47.4 | 52.3 | 45.8 | 53.4 | 42.3 | 52.6 | 55.7 | 44.7 | 45.3 | 40.6 |
| 7  | 75.0 | 53.0 | 51.2 | 55.4 | 59.8 | 46.2 | 52.5 | 43.9 | 41.9 | 60.2 | 60.2 | 64.5 |
| 8  | 51.2 | 58.3 | 51.2 | 56.0 | 55.6 | 48.9 | 48.0 | 48.1 | 48.7 | 54.5 | 52.8 | 48.6 |
| 9  | 52.9 | 56.9 | 54.1 | 55.9 | 52.5 | 55.9 | 49.5 | 55.4 | 55.6 | 51.6 | 52.5 | 49.7 |
| 10 | 52.4 | 65.1 | 72.0 | 56.7 | 55.5 | 52.2 | 51.1 | 51.1 | 48.9 | 53.9 | 55.1 | 51.3 |
| 11 | 52.0 | 56.5 | 55.2 | 53.1 | 50.3 | 54.5 | 48.9 | 55.0 | 53.3 | 49.5 | 50.8 | 47.2 |
| 12 | 47.4 | 52.8 | 52.3 | 54.9 | 48.9 | 61.7 | 51.6 | 63.7 | 63.2 | 49.7 | 47.3 | 47.2 |
| 13 |      | 51.2 | 50.6 | 54.1 | 61.1 | 45.4 | 50.8 | 45.0 | 43.5 | 60.1 | 61.6 | 61.5 |
| 14 | 65.7 |      | 65.3 | 57.4 | 54.0 | 45.8 | 53.5 | 47.7 | 45.1 | 53.1 | 51.7 | 49.7 |
| 15 | 64.1 | 73.7 |      | 54.7 | 53.6 | 46.6 | 52.2 | 48.4 | 46.9 | 53.8 | 53.1 | 48.4 |
| 16 | 64.3 | 67.3 | 66.1 |      | 58.8 | 51.3 | 58.7 | 50.8 | 49.2 | 53.6 | 58.2 | 49.7 |
| 17 | 71.6 | 65.1 | 66.9 | 72.2 |      | 46.2 | 55.5 | 46.5 | 46.5 | 83.7 | 93.8 | 58.3 |
| 18 | 62.2 | 62.2 | 62.2 | 63.4 | 61.6 |      | 47.0 | 57.7 | 55.9 | 46.2 | 46.9 | 41.6 |
| 19 | 63.0 | 69.4 | 66.5 | 71.7 | 67.6 | 66.5 |      | 48.5 | 46.3 | 51.3 | 54.5 | 58.0 |
| 20 | 60.3 | 64.4 | 64.4 | 66.7 | 61.5 | 77.6 | 69.5 |      | 90.9 | 44.4 | 46.5 | 42.0 |
| 21 | 59.8 | 62.1 | 63.2 | 63.2 | 63.8 | 71.3 | 67.8 | 95.4 |      | 44.5 | 43.5 | 42.5 |
| 22 | 69.3 | 63.6 | 66.5 | 68.2 | 88.6 | 63.1 | 65.9 | 59.1 | 60.8 |      | 84.5 | 55.2 |
| 23 | 69.9 | 62.5 | 63.6 | 68.2 | 94.3 | 61.4 | 67.6 | 61.4 | 60.8 | 89.8 |      | 56.5 |
| 24 | 69.3 | 64.8 | 64.2 | 61.5 | 72.6 | 58.7 | 69.8 | 59.8 | 61.5 | 69.8 | 70.9 |      |
| 25 | 69.8 | 63.7 | 64.2 | 63.1 | 72.6 | 60.3 | 70.9 | 60.3 | 60.9 | 70.4 | 71.5 | 99.4 |
| 26 | 59.8 | 59.2 | 59.8 | 62.6 | 61.5 | 59.8 | 58.7 | 58.7 | 60.3 | 61.5 | 63.7 | 55.9 |
| 27 | 59.4 | 63.3 | 63.9 | 61.7 | 60.0 | 71.7 | 66.7 | 73.3 | 71.7 | 63.9 | 61.7 | 61.7 |
| 28 | 61.0 | 63.7 | 62.1 | 74.7 | 65.4 | 60.4 | 68.7 | 61.0 | 63.2 | 65.9 | 65.9 | 66.5 |
| 29 | 61.0 | 63.7 | 62.1 | 74.7 | 65.4 | 60.4 | 68.7 | 61.0 | 63.2 | 65.9 | 65.9 | 66.5 |
| 30 | 62.1 | 66.5 | 64.3 | 70.3 | 64.8 | 63.2 | 92.9 | 66.5 | 64.8 | 66.5 | 66.5 | 70.9 |
| 31 | 69.0 | 63.6 | 60.9 | 64.7 | 69.0 | 58.2 | 68.5 | 60.3 | 59.8 | 69.0 | 69.0 | 90.2 |
| 32 | 53.8 | 54.9 | 59.8 | 58.7 | 58.2 | 57.1 | 57.1 | 56.0 | 57.1 | 58.7 | 60.3 | 54.3 |
| 33 | 62.0 | 63.6 | 63.1 | 67.4 | 65.2 | 60.4 | 85.6 | 64.7 | 63.1 | 65.8 | 66.3 | 69.5 |
| 34 | 67.6 | 63.3 | 60.6 | 63.3 | 68.6 | 58.0 | 67.0 | 58.0 | 59.6 | 67.0 | 72.3 | 89.9 |
| 35 | 60.9 | 60.4 | 59.9 | 60.4 | 68.2 | 57.8 | 65.6 | 56.3 | 57.8 | 69.3 | 69.3 | 67.2 |
| 36 | 58.2 | 61.7 | 57.7 | 61.2 | 68.9 | 57.7 | 65.8 | 55.6 | 56.1 | 72.4 | 67.9 | 65.8 |
| 37 | 55.8 | 61.4 | 60.9 | 57.9 | 66.5 | 56.9 | 65.5 | 56.9 | 56.9 | 69.0 | 68.5 | 65.5 |
| 38 | 49.8 | 52.1 | 52.5 | 54.8 | 54.3 | 53.0 | 55.7 | 53.9 | 52.1 | 55.3 | 54.3 | 52.1 |
| 39 | 48.1 | 49.4 | 52.4 | 49.8 | 50.6 | 48.5 | 49.8 | 48.9 | 49.8 | 54.1 | 51.9 | 49.4 |
| 40 | 49.8 | 47.7 | 52.3 | 49.0 | 49.0 | 47.7 | 48.5 | 50.6 | 53.1 | 50.6 | 50.6 | 50.2 |
| 41 | 47.7 | 47.7 | 49.4 | 47.3 | 48.6 | 47.7 | 48.1 | 46.9 | 50.2 | 51.4 | 51.0 | 49.4 |

TABLE B3-continued

MatGAT results for global similarity and identity over the full length of the polypeptide sequences.

| | | | | | | | | | | | |
|---|---|---|---|---|---|---|---|---|---|---|---|
| 42 | 42.3 | 42.7 | 46.0 | 44.4 | 44.8 | 44.8 | 43.5 | 43.5 | 43.5 | 44.0 | 46.0 | 42.7 |
| 43 | 33.7 | 34.9 | 38.4 | 35.2 | 35.6 | 36.5 | 34.0 | 36.2 | 35.6 | 36.2 | 37.1 | 34.3 |

| | 25 | 26 | 27 | 28 | 29 | 30 | 31 | 32 | 33 | 34 | 35 | 36 |
|---|---|---|---|---|---|---|---|---|---|---|---|---|
| 1 | 51.6 | 49.2 | 46.8 | 58.2 | 58.2 | 58.2 | 52.1 | 47.1 | 56.1 | 52.6 | 49.7 | 47.6 |
| 2 | 47.3 | 50.0 | 46.4 | 51.6 | 51.6 | 47.3 | 50.3 | 50.3 | 47.3 | 47.7 | 50.5 | 51.8 |
| 3 | 48.6 | 48.1 | 50.5 | 52.2 | 52.2 | 51.6 | 48.4 | 44.7 | 50.8 | 46.6 | 46.1 | 44.7 |
| 4 | 40.6 | 45.3 | 47.0 | 46.2 | 46.2 | 46.7 | 41.2 | 44.1 | 44.5 | 40.9 | 45.0 | 44.6 |
| 5 | 52.9 | 48.9 | 47.3 | 59.6 | 59.6 | 57.8 | 53.4 | 46.6 | 55.8 | 54.4 | 50.3 | 47.8 |
| 6 | 41.1 | 51.1 | 48.9 | 46.8 | 46.8 | 41.4 | 42.0 | 48.6 | 42.1 | 43.3 | 44.9 | 46.0 |
| 7 | 64.5 | 44.7 | 45.5 | 54.1 | 54.1 | 52.7 | 64.9 | 44.6 | 51.1 | 61.8 | 51.5 | 51.7 |
| 8 | 47.0 | 50.0 | 45.2 | 50.5 | 50.5 | 48.6 | 50.0 | 47.9 | 47.4 | 48.4 | 46.2 | 48.3 |
| 9 | 49.7 | 46.9 | 53.0 | 49.7 | 49.7 | 48.7 | 50.2 | 46.8 | 48.5 | 49.7 | 48.2 | 46.8 |
| 10 | 50.8 | 47.5 | 46.6 | 52.9 | 52.9 | 51.1 | 50.8 | 46.6 | 49.2 | 50.0 | 47.7 | 47.5 |
| 11 | 45.6 | 48.3 | 51.6 | 48.5 | 48.5 | 47.2 | 49.8 | 46.2 | 46.5 | 49.2 | 46.7 | 45.5 |
| 12 | 46.7 | 46.2 | 61.1 | 47.7 | 47.7 | 50.3 | 44.8 | 41.1 | 49.0 | 46.0 | 47.7 | 45.5 |
| 13 | 61.5 | 43.6 | 42.8 | 52.4 | 52.4 | 51.0 | 61.1 | 43.7 | 49.7 | 61.1 | 52.8 | 52.0 |
| 14 | 49.7 | 45.5 | 50.0 | 53.5 | 53.5 | 53.4 | 50.8 | 45.1 | 50.3 | 52.3 | 51.8 | 51.0 |
| 15 | 47.3 | 46.3 | 50.5 | 51.6 | 51.6 | 52.1 | 47.9 | 45.5 | 49.7 | 49.0 | 47.8 | 48.8 |
| 16 | 50.3 | 47.9 | 50.0 | 65.8 | 65.8 | 59.3 | 53.1 | 47.2 | 56.8 | 53.8 | 51.5 | 52.5 |
| 17 | 58.3 | 46.6 | 44.8 | 55.6 | 55.6 | 56.2 | 58.9 | 43.9 | 54.2 | 55.9 | 61.5 | 61.8 |
| 18 | 40.7 | 44.6 | 54.2 | 46.6 | 46.6 | 45.9 | 41.4 | 41.5 | 42.9 | 42.8 | 43.1 | 42.7 |
| 19 | 58.0 | 42.6 | 49.5 | 58.7 | 58.7 | 91.2 | 54.4 | 44.8 | 81.9 | 53.5 | 55.3 | 55.2 |
| 20 | 42.0 | 44.9 | 60.1 | 43.5 | 43.5 | 47.4 | 41.3 | 42.6 | 46.0 | 41.3 | 43.5 | 43.9 |
| 21 | 41.6 | 44.7 | 60.5 | 43.1 | 43.1 | 45.8 | 40.0 | 41.4 | 43.3 | 41.4 | 44.9 | 44.9 |
| 22 | 55.7 | 49.0 | 45.9 | 52.3 | 52.3 | 52.3 | 56.3 | 46.0 | 52.1 | 55.0 | 60.9 | 62.5 |
| 23 | 58.0 | 47.4 | 45.9 | 54.7 | 54.7 | 55.2 | 58.1 | 46.2 | 52.3 | 58.2 | 62.2 | 61.8 |
| 24 | 97.2 | 37.2 | 41.8 | 56.7 | 56.7 | 57.3 | 81.1 | 40.3 | 56.3 | 80.9 | 57.1 | 55.5 |
| 25 | | 37.2 | 42.8 | 57.2 | 57.2 | 56.8 | 82.2 | 40.8 | 56.3 | 81.4 | 55.6 | 54.5 |
| 26 | 56.4 | | 43.5 | 44.7 | 44.7 | 43.2 | 39.0 | 69.5 | 42.2 | 40.8 | 44.1 | 43.7 |
| 27 | 62.8 | 56.7 | | 46.6 | 46.6 | 49.1 | 41.6 | 41.6 | 49.5 | 40.7 | 46.2 | 45.7 |
| 28 | 67.0 | 60.4 | 63.7 | | 100.0 | 59.7 | 55.9 | 43.8 | 57.1 | 58.0 | 52.3 | 53.0 |
| 29 | 67.0 | 60.4 | 63.7 | 100.0 | | 59.7 | 55.9 | 43.8 | 57.1 | 58.0 | 52.3 | 53.0 |
| 30 | 72.0 | 60.4 | 68.1 | 71.4 | 71.4 | | 55.2 | 45.2 | 83.9 | 55.2 | 54.5 | 54.9 |
| 31 | 89.7 | 56.5 | 60.3 | 71.2 | 71.2 | 71.7 | | 40.6 | 54.7 | 83.6 | 56.2 | 56.9 |
| 32 | 54.9 | 75.0 | 54.3 | 60.3 | 60.3 | 59.8 | 58.2 | | 43.7 | 38.7 | 44.1 | 44.4 |
| 33 | 70.1 | 59.4 | 64.2 | 70.1 | 70.1 | 88.8 | 71.1 | 58.8 | | 54.0 | 51.9 | 50.5 |
| 34 | 89.9 | 55.9 | 58.0 | 67.0 | 67.0 | 68.6 | 93.1 | 55.3 | 69.1 | | 57.2 | 57.6 |
| 35 | 66.7 | 57.3 | 59.4 | 64.1 | 64.1 | 67.7 | 67.7 | 57.3 | 66.1 | 68.8 | | 81.7 |
| 36 | 64.3 | 54.6 | 57.1 | 63.3 | 63.3 | 67.3 | 67.3 | 57.7 | 66.3 | 65.8 | 87.2 | |
| 37 | 65.0 | 55.8 | 59.9 | 64.0 | 64.0 | 65.5 | 67.0 | 56.3 | 64.5 | 68.5 | 93.4 | 89.3 |
| 38 | 53.4 | 58.0 | 54.8 | 54.3 | 54.3 | 60.3 | 53.9 | 55.7 | 55.7 | 53.9 | 57.1 | 55.3 |
| 39 | 51.1 | 52.4 | 50.2 | 52.8 | 52.8 | 53.2 | 52.4 | 53.2 | 52.8 | 52.4 | 54.9 | 55.4 |
| 40 | 51.0 | 55.2 | 52.7 | 49.0 | 49.0 | 50.6 | 54.0 | 52.3 | 50.6 | 49.8 | 55.6 | 54.4 |
| 41 | 52.3 | 56.0 | 51.9 | 49.4 | 49.4 | 52.3 | 52.3 | 51.0 | 50.6 | 50.2 | 55.1 | 53.1 |
| 42 | 42.3 | 56.9 | 42.3 | 45.2 | 45.2 | 45.6 | 44.8 | 74.2 | 45.6 | 43.5 | 45.6 | 47.6 |
| 43 | 34.3 | 45.1 | 34.9 | 36.8 | 36.8 | 35.6 | 36.8 | 58.4 | 36.2 | 36.5 | 37.8 | 37.1 |

| | 37 | 38 | 39 | 40 | 41 | 42 | 43 |
|---|---|---|---|---|---|---|---|
| 1 | 48.5 | 42.4 | 39.1 | 37.3 | 37.8 | 34.8 | 28.1 |
| 2 | 50.3 | 44.6 | 41.0 | 41.7 | 40.7 | 37.5 | 30.5 |
| 3 | 43.4 | 42.5 | 39.1 | 38.3 | 37.9 | 33.7 | 27.0 |
| 4 | 42.9 | 38.2 | 35.2 | 34.6 | 35.0 | 35.1 | 28.9 |
| 5 | 47.8 | 41.5 | 39.5 | 37.7 | 38.6 | 35.6 | 28.4 |
| 6 | 43.3 | 40.3 | 36.5 | 36.0 | 35.0 | 37.1 | 29.8 |
| 7 | 52.2 | 37.2 | 35.0 | 34.2 | 34.3 | 33.9 | 27.8 |
| 8 | 44.3 | 43.4 | 37.6 | 37.4 | 37.1 | 38.1 | 30.7 |
| 9 | 46.1 | 42.1 | 39.5 | 41.0 | 39.9 | 37.2 | 30.9 |
| 10 | 47.8 | 39.8 | 37.0 | 36.9 | 37.4 | 36.4 | 30.0 |
| 11 | 44.6 | 42.5 | 39.5 | 39.7 | 37.9 | 36.8 | 30.3 |
| 12 | 47.0 | 40.0 | 39.1 | 36.8 | 36.6 | 32.7 | 27.6 |
| 13 | 49.8 | 37.8 | 39.7 | 37.4 | 36.3 | 33.9 | 27.4 |
| 14 | 52.0 | 40.3 | 37.0 | 37.6 | 36.6 | 34.6 | 29.3 |
| 15 | 50.7 | 40.9 | 39.7 | 37.9 | 38.3 | 35.3 | 28.3 |
| 16 | 49.8 | 42.9 | 41.1 | 38.4 | 37.7 | 37.0 | 29.6 |
| 17 | 59.5 | 38.5 | 38.0 | 36.2 | 36.7 | 34.1 | 27.1 |
| 18 | 43.5 | 39.7 | 36.2 | 37.2 | 38.8 | 34.7 | 28.9 |
| 19 | 55.0 | 42.7 | 39.8 | 36.1 | 36.7 | 34.7 | 26.9 |
| 20 | 43.4 | 38.9 | 37.3 | 37.5 | 37.9 | 35.7 | 29.2 |
| 21 | 42.8 | 38.2 | 39.5 | 38.2 | 37.0 | 34.3 | 28.0 |
| 22 | 59.0 | 40.8 | 40.7 | 37.7 | 38.2 | 34.7 | 28.9 |
| 23 | 61.7 | 38.8 | 40.1 | 38.2 | 38.7 | 35.6 | 28.7 |
| 24 | 55.7 | 37.2 | 37.1 | 34.3 | 35.0 | 31.6 | 26.6 |
| 25 | 55.2 | 37.7 | 37.1 | 34.3 | 34.4 | 31.3 | 26.6 |
| 26 | 42.2 | 46.8 | 43.8 | 46.3 | 45.1 | 53.3 | 42.2 |

TABLE B3-continued

MatGAT results for global similarity and identity over the full length of the polypeptide sequences.

| | | | | | | | |
|---|---|---|---|---|---|---|---|
| 27 | 46.5 | 39.5 | 39.9 | 39.7 | 39.1 | 33.3 | 27.8 |
| 28 | 52.2 | 41.9 | 42.7 | 39.3 | 38.2 | 34.9 | 29.2 |
| 29 | 52.2 | 41.9 | 42.7 | 39.3 | 38.2 | 34.9 | 29.2 |
| 30 | 54.1 | 43.4 | 41.6 | 36.4 | 38.3 | 35.4 | 27.6 |
| 31 | 53.9 | 41.3 | 39.0 | 37.2 | 35.7 | 31.7 | 27.0 |
| 32 | 42.0 | 45.4 | 44.1 | 43.6 | 42.6 | 74.2 | 58.4 |
| 33 | 51.6 | 41.3 | 37.1 | 35.7 | 36.6 | 34.4 | 27.7 |
| 34 | 57.3 | 39.0 | 36.9 | 33.6 | 34.4 | 30.2 | 25.9 |
| 35 | 88.8 | 40.9 | 40.7 | 39.0 | 39.3 | 34.3 | 28.2 |
| 36 | 81.6 | 41.6 | 41.0 | 38.8 | 39.8 | 34.2 | 28.7 |
| 37 | | 43.4 | 41.4 | 39.0 | 39.5 | 34.4 | 27.8 |
| 38 | 58.0 | | 64.4 | 58.6 | 58.5 | 37.9 | 30.8 |
| 39 | 56.7 | 73.4 | | 72.2 | 73.7 | 40.4 | 32.9 |
| 40 | 55.6 | 68.6 | 81.6 | | 95.1 | 41.1 | 35.2 |
| 41 | 53.5 | 67.5 | 81.5 | 95.9 | | 41.1 | 36.1 |
| 42 | 46.0 | 51.6 | 54.8 | 54.8 | 56.5 | | 73.0 |
| 43 | 36.5 | 41.9 | 45.1 | 46.7 | 48.6 | 74.3 | |

3.4 TPS, TPP and TPS-TPP Polypeptide

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were: Scoring matrix: Blosum62, First Gap: 12, Extending Gap: 2.

TABLE B4

MatGAT results for global similarity and identity over the full length of TPS, TPP and TPS-TPP polypeptide sequences.

| Polypeptide number | 3 | 5 | 8 | 9 | 12 | 22 | 47 | 48 | 52 | 65 | 73 | 74 | 75 | 76 | 85 | 89 |
|---|---|---|---|---|---|---|---|---|---|---|---|---|---|---|---|---|
| 3 | | 65.0 | 71.0 | 60.0 | 29.0 | 29.0 | 29.0 | 28.0 | 11.0 | 10.0 | 12.0 | 12.0 | 11.0 | 12.0 | 11.0 | 13.0 |
| 5 | | | 50.0 | 46.0 | 23.0 | 21.0 | 21.0 | 21.0 | 18.0 | 30.0 | 19.0 | 20.0 | 18.0 | 17.0 | 15.0 | 17.0 |
| 8 | | | | 61.0 | 28.0 | 29.0 | 30.0 | 29.0 | 13.0 | 10.0 | 11.0 | 11.0 | 11.0 | 14.0 | 9.0 | 13.0 |
| 9 | | | | | 27.0 | 29.0 | 30.0 | 28.0 | 12.0 | 11.0 | 10.0 | 11.0 | 11.0 | 13.0 | 9.0 | 13.0 |
| 12 | | | | | | 30.0 | 29.0 | 29.0 | 16.0 | 13.0 | 13.0 | 14.0 | 14.0 | 15.0 | 12.0 | 16.0 |
| 22 | | | | | | | 64.0 | 52.0 | 13.0 | 13.0 | 13.0 | 13.0 | 12.0 | 13.0 | 10.0 | 12.0 |
| 47 | | | | | | | | 50.0 | 12.0 | 13.0 | 12.0 | 11.0 | 12.0 | 13.0 | 10.0 | 12.0 |
| 48 | | | | | | | | | 13.0 | 11.0 | 12.0 | 12.0 | 12.0 | 13.0 | 10.0 | 12.0 |
| 52 | | | | | | | | | | 50.0 | 47.0 | 51.0 | 52.0 | 45.0 | 44.0 | 49.0 |
| 65 | | | | | | | | | | | 58.0 | 60.0 | 59.0 | 50.0 | 49.0 | 51.0 |
| 73 | | | | | | | | | | | | 68.0 | 57.0 | 51.0 | 49.0 | 52.0 |
| 74 | | | | | | | | | | | | | 62.0 | 51.0 | 49.0 | 55.0 |
| 75 | | | | | | | | | | | | | | 53.0 | 54.0 | 58.0 |
| 76 | | | | | | | | | | | | | | | 46.0 | 70.0 |
| 85 | | | | | | | | | | | | | | | | 52.0 |
| 89 | | | | | | | | | | | | | | | | |

| Polypeptide number | Name polypeptide |
|---|---|
| 3. | A. thaliana__AT1G78580.1#1__Class-I |
| 5. | A. thaliana__DNTPS1-TPPB |
| 8. | S. bicolor__Sb09g025790.1#1__Class-I |
| 9. | S. lepidophylla__U96736#1__Class-I |
| 12. | A. dehalogenans__YP_463663.1__BAC_Fusion |
| 22. | A. thaliana__AT1G06410.1#1__Class-II |
| 47. | Z. mays__ZM07MC29609__BFb0010E24@29519#1__Class-II |
| 48. | Z. mays__ZM07MC36251__BFb0274J14@36138#1__Class-II |
| 52. | G. max__GM06MC27748__sae81b02@27120#1__Class-III-A |
| 65. | A. thaliana__AT1G78090.1#1__Class-III-B |
| 73. | G. max__GM06MC01001__47125400@994#1__Class-III-B |
| 74. | G. max__GM06MC02336__48986355@2319#1__Class-III-B |
| 75. | G. max__GM06MC07245__50736990@7181#1__Class-III-B |
| 76. | H. vulgare__c62965763hv270303@10320#1__Class-III-B |
| 85. | T. aestivum__TA06MC06019__54656424@6005#1__Class-III-B |
| 89. | Z. mays__ZM07MC27735__BFb0207C15@27651#1__Class-III-B |

Example 4

Identification of Domains Comprised in Polypeptide Sequences Useful in Performing the Methods of the Invention

4.1 CLC-Like Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 2 are presented in Table C1.

\# CLC-LIKE Length: 783
\# CLC-LIKE Number of predicted TMHs: 8
\# CLC-LIKE Exp number of AAs in TMHs: 208.85297
\# CLC-LIKE Exp number, first 60 AAs: 0.00364
\# CLC-LIKE Total prob of N-in: 0.07922

| | | | | |
|---|---|---|---|---|
| CLC-LIKE | TMHMM2.0 | outside | 1 | 97 |
| CLC-LIKE | TMHMM2.0 | TMhelix | 98 | 120 |
| CLC-LIKE | TMHMM2.0 | inside | 121 | 140 |
| CLC-LIKE | TMHMM2.0 | TMhelix | 141 | 163 |
| CLC-LIKE | TMHMM2.0 | outside | 164 | 254 |
| CLC-LIKE | TMHMM2.0 | TMhelix | 255 | 277 |
| CLC-LIKE | TMHMM2.0 | inside | 278 | 289 |
| CLC-LIKE | TMHMM2.0 | TMhelix | 290 | 309 |
| CLC-LIKE | TMHMM2.0 | outside | 310 | 339 |
| CLC-LIKE | TMHMM2.0 | TMhelix | 340 | 362 |
| CLC-LIKE | TMHMM2.0 | inside | 363 | 381 |
| CLC-LIKE | TMHMM2.0 | TMhelix | 382 | 404 |
| CLC-LIKE | TMHMM2.0 | outside | 405 | 469 |
| CLC-LIKE | TMHMM2.0 | TMhelix | 470 | 492 |
| CLC-LIKE | TMHMM2.0 | inside | 493 | 538 |
| CLC-LIKE | TMHMM2.0 | TMhelix | 539 | 561 |
| CLC-LIKE | TMHMM2.0 | outside | 562 | 783 |

4.2 OsBURP-Like Polypeptides

The Integrated Resource of Protein Families, Domains and Sites (InterPro) database is an integrated interface for the

TABLE C1

InterPro scan results (major accession numbers) of the polypeptide sequence as represented by SEQ ID NO: 2.

| Database | Accession number | Accession name | Amino acid coordinates on SEQ ID NO 2 |
|---|---|---|---|
| InterPro | IPR000644 | Cystathionine beta-synthase, core | |
| HMMPfam | PF00571 | CBS | T[604-769] 5.5e−08 |
| InterPro | IPR001807 | Chloride channel, voltage gated | |
| FPrintScan | PR00762 | CLCHANNEL | T[166-183] 2e−60 |
| | | | T[197-216] 2e−60 |
| | | | T[261-280] 2e−60 |
| | | | T[486-506] 2e−60 |
| | | | T[518-534] 2e−60 |
| | | | T[536-555] 2e−60 |
| | | | T[574-588] 2e−60 |
| HMMPanther | PTHR11689 | CHLORIDE CHANNEL | T[33-429] 0 |
| | | | T[447-780] 0 |
| InterPro | IPR002251 | Chloride channel plant CLC | |
| FPrintScan | PR01120 | CLCHANNELPLT | T[71-79] 1.9e−18 |
| | | | T[282-290] 1.9e−18 |
| | | | T[296-306] 1.9e−18 |
| | | | T[314-321] 1.9e−18 |
| | | | T[438-454] 1.9e−18 |
| InterPro | IPR014743 | Chloride channel, core | |
| Gene3D | G3DSA:1.10.3080.10 | no description | T[79-595] 4.6e−93 |
| HMMPfam | PF00654 | Voltage_CLC | T[149-571] 5.1e−165 |
| superfamily | SSF81340 | Clc chloride channel | T[74-591] 2.4e−93 |
| InterPro | NULL | NULL | |
| HMMPanther | PTHR11689:SF11 | CHLORIDE CHANNEL CLC, PLANT | T[33-429] 0 |
| | | | T[447-780] 0 |

Furthermore, CLC-like polypeptides are located in the membrane. When analysed with TMHMM (Krogh et al., Journal of Molecular Biology, 305(3):567-580, January 2001; Sonnhammer et al., In J. Glasgow, T. Littlejohn, F. Major, R. Lathrop, D. Sankoff, and C. Sensen, editors, Proceedings of the Sixth International Conference on Intelligent Systems for Molecular Biology, pages 175-182, Menlo Park, Calif., 1998. AAAI Press), SEQ ID NO: 2 is predicted to have 8 transmembrane domains.

commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 95 are presented in Table C2.

TABLE C2

InterPro scan results (major accession numbers) of the polypeptide sequence as represented by SEQ ID NO: 95.

| Database | Accession number | Accession name | Amino acid coordinates on SEQ ID NO 95 |
|---|---|---|---|
| InterPro | PR004873 | BURP | |
| HMMPfam | PF03181 | BURP | T[65-287] 1.5000E−70 |

4.3 AP2/ERF-Like Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 160 are presented in Table C3.

TABLE C3

InterPro scan results (major accession numbers) of the polypeptide sequence as represented by SEQ ID NO: 160.

| Database | Accession number | Accession name |
|---|---|---|
| IPR001471 | PF00847 | AP2 |

4.4 TPS, TPP and TPS-TPP Polypeptide

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by TPS-TPP polypeptide A.thaliana_DNTPS1-TPP (SEQ ID NO: 441) are presented in Table C4.

TABLE C4

InterPro scan results (major accession numbers) of the polypeptide sequence as represented by SEQ ID NO: 441.

| Method | Domain ID and name | Short Name | Evalue [amino acid coordinates] |
|---|---|---|---|
| PFAM | PF0098 Glycosyl transferase, family 20 | Glyco_transf_20 | 3.9e−288 [6-473]T |
| PFAM | PF02358 Trehalose-phosphatase | Trehalose_PPase | 1.9e−92 [517-757]T 2.4e−111 [980-1213]T |
| TIGRFAMs | TIGR00685 T6PP: trehalose-phosphatase | T6PP: trehalose-phosphatase | 7e−45 [974-1224]T |
| TIGRFAMs | TIGR01484 HAD-superfamily hydrolase, subfamily IIB | HAD-SF-IIB: HAD-superfamily hydrolase, subf | 1.1e−21 [978-1191]T |
| TIGRFAMs | TIGR02400 Alpha, alpha-trehalose-phosphate synthase | trehalose_OtsA: alpha, alpha-trehalose-phosp | 2.4e−299 [7-473]T |
| GENE3D | G3DSA:3.40.50.1000 no description | | 2.9e−38 [976-1222]T |
| GENE3D | G3DSA:3.40.50.2000 no description | | 9.7e−80 [12-267]T |
| PANTHER | PTHR10788 TREHALOSE-6-PHOSPHATE SYNTHASE | TREHALOSE-6-PHOSPHATE SYNTHASE | 6.6e−228 [70-798]T |
| SUPERFAMILY | SSF53756 UDP-Glycosyltransferase/ glycogen phosphorylase | UDP-Glycosyltransferase/ glycogen phosphorylase | 5.1e−163 [6-477]T |
| SUPERFAMILY | SSF56784 HAD-like | HAD-like | 4.2e−49 [977-1230]T 5.2e−26 [504-709]T 0.019 [821-850]T |

Example 5

Topology Prediction of the Polypeptide Sequences Useful in Performing the Methods of Invention

5.1 CLC-Like Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 2 are presented Table D1. The "plant" organism group has been selected, no cutoffs defined, and the predicted length of the transit peptide requested. The subcellular localization of the polypeptide sequence as represented by SEQ ID NO: 2 is likely not the chloroplast or the mitochondrion. Given the homology to AtCLCa, the subcellular localisation may be the tonoplast.

TABLE D1

TargetP 1.1 analysis of the polypeptide sequence as represented by SEQ ID NO: 2

| Name | Len | cTP | mTP | SP | other | Loc | RC | TPlen |
|---|---|---|---|---|---|---|---|---|
| SEQ ID NO: 2 | 783 | 0.236 | 0.081 | 0.107 | 0.898 | — | 2 | — |
| cutoff | | 0.000 | 0.000 | 0.000 | 0.000 | | | |

Abbreviations:
Len, Length;
cTP, Chloroplastic transit peptide;
mTP, Mitochondrial transit peptide,
SP, Secretory pathway signal peptide,
other, Other subcellular targeting,
Loc, Predicted Location;
RC, Reliability class;
TPlen, Predicted transit peptide length.

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

5.2 OsBURP-Like Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 95 are presented Table D2. The "plant" organism group has been selected, no cutoffs defined, and the predicted length of the transit peptide requested. The OsBURP-like protein represented by SEQ ID NO: 95 is predicted to be secreted, with a putative signal peptide cleavage site between amino acids A21 and A22. Also in other OsBURP-like proteins, a secretion signal is postulated (Hattori et al., 1998).

TABLE D2

TargetP 1.1 analysis of the polypeptide sequence as represented by SEQ ID NO: 95.

| Name | Len | cTP | mTP | SP | other | Loc | RC | TPlen |
|---|---|---|---|---|---|---|---|---|
| SEQ ID NO: 95 | 287 | 0.007 | 0.107 | 0.848 | 0.031 | S | 2 | 21 |
| cutoff | | 0.000 | 0.000 | 0.000 | 0.000 | | | |

Abbreviations:
Len, Length;
cTP, Chloroplastic transit peptide;
mTP, Mitochondrial transit peptide,
SP, Secretory pathway signal peptide,
other, Other subcellular targeting,
Loc, Predicted Location;
RC, Reliability class;
TPlen, Predicted transit peptide length.

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

5.3 AP2/ERF-Like Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:
  ChloroP 1.1 hosted on the server of the Technical University of Denmark;
  Protein Prowler Subcellular Localisation Predictor version 1.2 hosted on the server of the Institute for Molecular Bioscience, University of Queensland, Brisbane, Australia;
  PENCE Proteome Analyst PA-GOSUB 2.5 hosted on the server of the University of Alberta, Edmonton, Alberta, Canada;
  TMHMM, hosted on the server of the Technical University of Denmark
  PSORT (URL: psort.org)
  PLOC (Park and Kanehisa, Bioinformatics, 19, 1656-1663, 2003).

5.4 TPS, TPP and TPS-TPP Polypeptide

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence, a potential cleavage site can also be predicted.

A number of parameters is selected, such as organism group (non-plant or plant), cutoff sets (none, predefined set of cutoffs, or user-specified set of cutoffs), and the calculation of prediction of cleavage sites (yes or no).

Many other algorithms can alternatively be used to determine the subcelullar localisation of a protein, including:
  ChloroP 1.1 hosted on the server of the Technical University of Denmark;
  Protein Prowler Subcellular Localisation Predictor version 1.2 hosted on the server of the Institute for Molecular Bioscience, University of Queensland, Brisbane, Australia;
  PENCE Proteome Analyst PA-GOSUB 2.5 hosted on the server of the University of Alberta, Edmonton, Alberta, Canada;
  TMHMM, hosted on the server of the Technical University of Denmark
  PSORT (URL: psort.org)
  PLOC (Park and Kanehisa, Bioinformatics, 19, 1656-1663, 2003).

Example 6

Assay Related to the Polypeptide Sequences Useful in Performing the Methods of the Invention 6.1 CLC-Like Polypeptides De Angeli (Nature 442, 939-942, 2006) has functionally characterised AtCLCa using the patch clamp technique on *Arabidopsis* mesophyl cells for measuring currents across the tonoplast. The patch clamp technique is well known in the art for studying ion channel activity in cells, see for example Hamill et al., Pflügers Archiv (European Journal of Physiology) 391, 85-100, 1981.

6.2 OBURP-Like Polypeptides

For transcript level analysis of OsBURP-like polypeptides under stress, plants are planted in plastic trays filled with sandy soil and placed in the greenhouse. Three-week old seedlings are prepared for abiotic stress treatments mainly according to Xiong and Yang (Plant Cell 2003, Vol. 15, pages 745-759). Drought stress is induced by withholding water from the trays, and seedling leaves are sampled at normal (before withholding water), slight drought [with the average relative water content (RWC) at about 90%], moderate drought (about half of leaves rolled, RWC at about 83%), and severe drought (all leaves completely rolled, RWC at about 70%) conditions. Seedling roots are submerged in 200 mM NaCl solution for salt stress, and seedling leaves are sampled at 0, 1, 6, and 12 h after the treatment. For ABA treatment, seedling leaves are sprayed with 0.1 mM ABA solution and sampled at 0, 10, 30 min, and 3 h after treatment. For cold stress, the seedlings are transferred into a growth chamber at 4° C. and sampled at 0, 1, 3, and 10 h after treatment.

Total RNA is extracted from plant samples using standard procedures. Gene specific primers are designed with standard methods, based on the sequences provided in the sequence listing. Real-time PCR is conducted using a household gene like Actin1 as internal standard and the relative expression levels are determined for example as described by Liang et al., Plant J 46:1059-1072, 2006.

6.3 AP2/ERF-Like Polypeptides

The functional assay for the AP2/ERF polypeptide is described in: Allen M D et al. EMBO J. 1998 Sep. 15; 17(18): 5484-96.

6.4 TPS, TPP and TPS-TPP Polypeptide

Concerning TPS Activity

Methods to determine enzymatic activity of TPS polypeptides are well known in the art. Typically the levels of Tre6P (trehalose 6-phosphate), which is the product of the reaction catalyzed by TPS are measured to infer the activity of the TPS enzyme. For example Lunn et al. (2006) in Biochem J. 397: 139-148, described a novel method using LC-MS-Q3 able to measure with 100 fold higher sensitivity the level of Tre6P (trehalose 6-phosphate), in plants, the product of the reaction that TPS catalyzes. Blazquez et al. (1994) in FEMS Microbiol Lett. 121:223-227 described a procedure for the quantitative determination of trehalose 6-phosphate (T6P) based on its ability to inhibit hexokinase from *Yarrowia lipolytica*. Van Vaeck et al. (2001) in Biochem J. 353:157-162 described a method to determine the levels of Tre6P using *B. substilis* Phosphotrehalase enzymatic assay.

In vivo activity of TPS polypeptides may also be determined, for example through complementation assays in *S. cerevisie* (Blazquez et al (1998) in Plant J. 13:685-689).

Concerning TPP Activity

Methods to determine enzymatic activity of TPP polypeptides are well known in the art. Typically the levels of Trehalose, which is the product of the reaction catalyzed by TPP are measured. For example a method using gas chromatography-mass spectrometry (GC-MS) analysis may be used such as the method described by Vogel et al. (1998) J. Exp. Bot. 52:1817-1826. Alternatively a method using trehalase may be used (Canovas et al. (2001). J. Bacteriol. 183:3365-3337; Kienle et al. (1993). Yeast. 9:607-611).

Further alternative biochemical assays to determine TPP activity by measuring the amount of Pi released from Tre6P have been described (Kluuts et al. (2003). J. Biol. Chem. 278:2093-2100)

In vivo activity of TPP polypeptides may also be determined, for example through complementation assays in *S. cerevisie* (Shima et al. (2007). FEBS J. 274(5):1192-1201; Vogel et al. (1998). Plant J 13:673-83).

Concerning TPS-TPP Activity

The TPS and TPP activity of a TPS-TPP polypeptide may be determined using any of the methods described below. Specific methods to measure TPS and TPP activity adapted to test the effect of the physical proximity of the TPS and TPP enzymes which catalyze a sequential reaction have been previously described (Seo et al. (2000). Applied and Environmental Microbiology. 66:2484-2490).

Example 7

Cloning of the Nucleic Acid Sequence Used in the Methods of the Invention 7.1 CLC-Like Polypeptides The nucleic acid sequence was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm3490 (SEQ ID NO: 92; sense, start codon in bold): 5'-ggggacaagtttgtacaaaaaagcag-gcttaaacaatggaggaggagcagagc-3' and prm3491 (SEQ ID NO: 93; reverse, complementary): 5'-ggggaccactttgtacaa-gaaagctgggtctcaaaaa tggttcctctcaa-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pCLC-like. Plasmid pDONR201 was purchased from Invitrogen, as part of the Gateway® technology.

The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 91) for constitutive specific expression was located upstream of this Gateway cassette.

Figure 4:
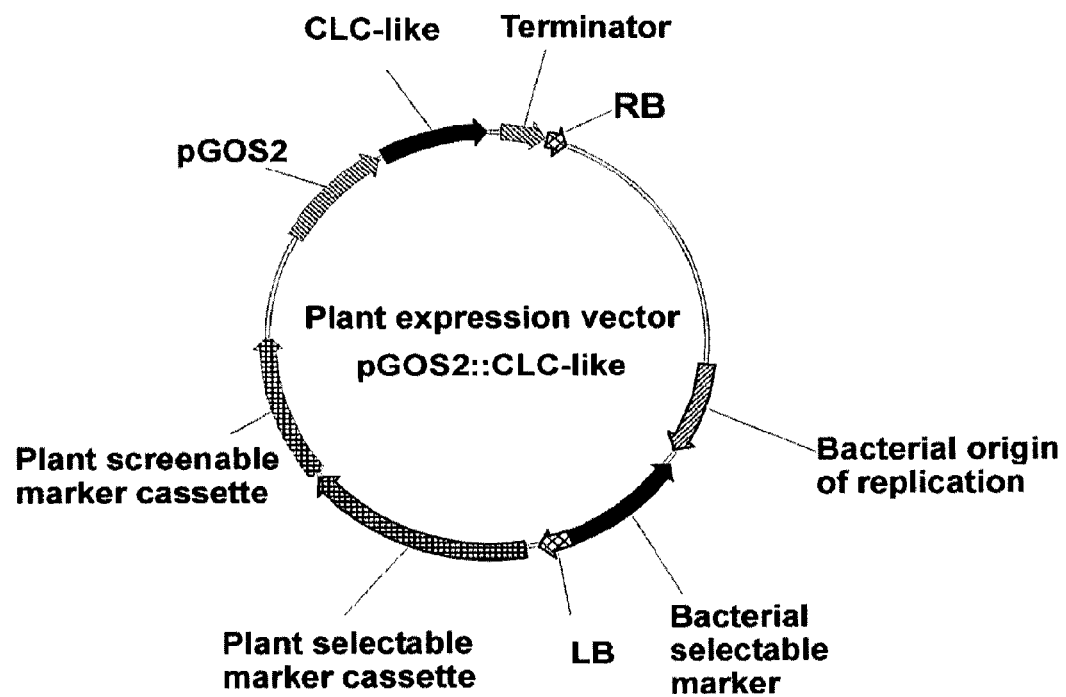
FIG. 4 represents the binary vector used for increased expression in *Oryza sativa* of a CLC-like-encoding nucleic acid under the control of a rice GOS2 promoter (pGOS2)

After the LR recombination step, the resulting expression vector pGOS2:CLC-like (FIG. 4) was transformed into *Agrobacterium* strain LBA4044 according to methods well known in the art.

7.2 OsBURP-Like Polypeptides

The nucleic acid sequence was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm13652 (SEQ ID NO: 157; sense, start codon in bold): 5'-ggggacaagtttgtacaaaaaagcag-gcttaaacaatggctaggtctctcgctgct-3' and prm13653 (SEQ ID NO: 158; reverse, complementary): 5'-ggggaccactttgtacaa-gaaagctgggtcgca ggtagctgcttcattca-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pOsBURP-like. Plasmid pDONR201 was purchased from Invitrogen, as part of the Gateway® technology.

The entry clone comprising SEQ ID NO: 94 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 156) for constitutive specific expression was located upstream of this Gateway cassette.

After the LR recombination step, the resulting expression vector pGOS2OsBURP-like (FIG. 8) was transformed into *Agrobacterium* strain LBA4044 according to methods well known in the art.

7.3 AP2/ERF-Like Polypeptides

The nucleic acid sequence was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm14304 (SEQ ID NO: 270; sense, start codon in bold): 5'-ggggacaagtttgtacaaaaaagcag-gcttaaacaatggacggtggaagagga-3' and prm14305 (SEQ ID NO: 271; reverse, complementary): 5'-ggggaccactttgtacaa-gaaagctgggtt ccaatatcaattaacatccca-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pAP2/ERF. Plasmid pDONR201 was purchased from Invitrogen, as part of the Gateway® technology.

The entry clone comprising SEQ ID NO: 159 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 269) for constitutive specific expression was located upstream of this Gateway cassette.

After the LR recombination step, the resulting expression vector pGOS2:AP2/ERF (FIG. 12) was transformed into *Agrobacterium* strain LBA4044 according to methods well known in the art.

7.4 TPS, TPP and TPS-TPP Polypeptide

Concerning TPS::TPP: (A.thaliana_DNTPS1-TPPB)

A clone comprising A.thaliana_DNTPS1-TPPB (SEQ ID NO: 440) has been previously described. The nucleic acid sequence was amplified by PCR using primers complementary to the 5' and 3' terminus of the coding sequence. The primers include the AttB sites for Gateway recombination.

The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pA.thaliana_DNTPS1-TPPB. Plasmid pDONR201 was purchased from Invitrogen, as part of the Gateway® technology.

The entry clone comprising (SEQ ID NO: 440) was then used in an LR reaction with a destination vector used for Oryza sativa transformation. This vector additionally contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 457) for constitutive specific expression was located upstream of this Gateway cassette.

After the LR recombination step, the resulting expression vector pGOS2:: A.thaliana_DNTPS1-TPPB fusion (FIG. 15) was transformed into Agrobacterium strain LBA4044 according to methods well known in the art.

Concerning TPS::TPP: S.cerevisiae_TPS1/TPS2_fusion

A clone comprising S.cerevisiae_TPS1/TPS2_fusion (SEQ ID NO: 442) has been previously described (Miranda et al. 2007 Planta 226:1411-21). The nucleic acid sequence was amplified by PCR using primers complementary to the 5' and 3' terminus of the coding sequence. The primers include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pS.cerevisiae_TPS1/TPS2_fusion. Plasmid pDONR201 was purchased from Invitrogen, as part of the Gateway® technology.

The entry clone comprising (SEQ ID NO: 442) was then used in an LR reaction with a destination vector used for Oryza sativa transformation. This vector additionally contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 457) for constitutive specific expression was located upstream of this Gateway cassette.

After the LR recombination step, the resulting expression vector pGOS2:: S.cerevisiae_TPS1/TPS2_fusion (FIG. 15) was transformed into Agrobacterium strain LBA4044 according to methods well known in the art.

Concerning chloroplatic TPS::TPP: (S.cerevisiae_Chl.TPS1/TPS2_fusion)

A clone comprising S.cerevisiae_TPS1/TPS2_fusion gene (SEQ ID NO: 444) has been previously described (Miranda et al. 2007 Planta 226:1411-21). The nucleic acid sequence was amplified by PCR using primers complementary to the 5' and 3' terminus of the coding sequence. The primers include the AttB sites for Gateway recombination. The amplified PCR fragment was purified also using standard methods.

A nucleic acid molecule encoding the chloroplast transient peptide of the small subunit of the rubisco enzyme of Arabidopsis thaliana and comprising the sequence represented by (SEQ ID NO: 455) was synthesized chemically. SEQ ID NO: 455 encodes the targeting peptide represented by SEQ ID NO: 456. The nucleic acid encoding such transient polypeptide was ligated to the 5' terminus of the PCR fragment comprising SEQ ID NO: 444 using standard procedures.

The first step of the Gateway procedure, the BP reaction, was then performed, during which the PCR fragment fused to the chloroplast signaling recombined in vivo with the pDONR201 plasmid to produce, according to the Gateway terminology, an "entry clone", pS.cerevisiae_Chl.TPS1/TPS2_fusion. Plasmid pDONR201 was purchased from Invitrogen, as part of the Gateway® technology.

The entry clone comprising the fusion of the chloroplast targeting signalling and SEQ ID NO: 444 was then used in an LR reaction with a destination vector used for Oryza sativa transformation. This vector additionally contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 457) for constitutive specific expression was located upstream of this Gateway cassette.

After the LR recombination step, the resulting expression vector pGOS2:: S.cerevisiae_Chl.TPS1/TPS2_fusion (FIG. 15) was transformed into Agrobacterium strain LBA4044 according to methods well known in the art.

Example 8

Plant Transformation

Rice Transformation

The Agrobacterium containing the expression vector was used to transform Oryza sativa plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

Agrobacterium strain LBA4404 containing the expression vector was used for co-cultivation. Agrobacterium was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Example 9

Transformation of Other Crops

Corn Transformation

Transformation of maize (Zea mays) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with Agrobacterium tumefaciens containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with Agrobacterium tumefaciens containing the expression vector, and transgenic plants are recovered through organogenesis. After incubation with Agrobacterium, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with Agrobacterium tumefaciens containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with Agrobacterium (containing the expression vector) by dipping the cut end of the petiole explant into the bacterial suspension. The explants are then cultured for 2 days on MSBAP-3 medium containing 3 mg/l BAP, 3% sucrose, 0.7 Phytagar at 23° C., 16 hr light. After two days of co-cultivation with Agrobacterium, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (Medicago sativa) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of Agrobacterium tumefaciens C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit Agrobacterium growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 µg/ml cefotaxime. The seeds are then transferred to SH-medium with 50 µg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 µg/ml MgCL2, and with 50 to 100 µg/ml cefotaxime and 400-500 µg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 10

Phenotypic Evaluation Procedure 10.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions were watered at regular intervals to ensure that water and nutrients were not limiting and to satisfy plant needs.

From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T2 seeds were grown in potting soil under normal conditions until they approached the heading stage. They were then transferred to a "dry" section where irrigation was withheld. Humidity probes were inserted in randomly chosen pots to monitor the soil water content (SWC). When SWC went below certain thresholds, the plants were automatically re-watered continuously until a normal level was reached again. The plants were then re-transferred again to normal conditions. The rest of the cultivation (plant maturation, seed harvest) was the same as for plants not grown under abiotic stress conditions. Growth and yield parameters were recorded as detailed for growth under normal conditions.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

10.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

10.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 11

Phenotypic Evaluation Procedure 11.1 CLC-Like Polypeptides

Transgenic rice plants expressing the CLC-like gene under the control of the GOS2 promoter had increased seed yield, in particular increased fillrate (proportion in % of the number of filled seeds over the number of florets), total weight of seeds (totalwgseeds, indication of the seed yield per plant in g), harvest index, number of filled seeds (nrfilledseed) and Thousand Kernel Weight (TKW, seed weight of 1000 seeds).

Furthermore, the plants were also taller (increased GravityYMax, which is the height of the gravity center of the leafy biomass and HeightMax, the height of the highest tip of the plant) and two of the tested lines had increased root biomass (increased RootMax (indication of total root biomass) and RootShlnd (the ratio between root mass and shoot mass in the period of active growth of root and shoot)) compared to the controls.

TABLE E1

Data summary for transgenic rice plants; for each parameter, the overall percent increase is shown for the T1 generation, for each parameter the p-value is <0.05.

| Parameter | Overall increase |
|---|---|
| totalwgseeds | 33.5 |
| nrfilledseed | 30.2 |
| fillrate | 42.9 |
| harvestindex | 36.1 |
| TKW | 3.5 |

11.2 OsBURP-Like Polypeptides

Transgenic rice plants expressing the OsBURP-like gene under the control of the GOS2 promoter had increased seed yield, in particular increased fillrate (proportion in % of the number of filled seeds over the number of florets), totalwgseeds (indication of the seed yield per plant in g) and Thousand Kernel Weight (TKW, seed weight of 1000 seeds).

Furthermore, an increase was observed for number of filled seeds, harvest index and number of flowers per panicle; the plants were also taller (increased GravityYMax, which is the height of the gravity center of the leafy biomass) compared to the controls (Table E2).

TABLE E2

Data summary for transgenic rice plants; for each parameter, the overall percent increase is shown and for each parameter the p-value is <0.05.

| Parameter | Overall increase or decrease |
|---|---|
| Totalwgseeds | 14.9 |
| Fillrate | 16.9 |
| Harvestindex | 15.1 |
| Flowerperpan | 6.9 |
| GravityYMax | 8.2 |
| Nrfilledseed | 11 |
| TKW | 4 |

In addition, some lines showed increased early vigour or had more root biomass.

11.3 AP2/ERF-Like Polypeptides

The results of the evaluation of transgenic rice plants expressing an AP2/ERF nucleic acid encoding the AP2/ERF polypeptide of SEQ ID NO: 160 under drought-stress conditions are presented hereunder in Table E3. An increase of more than 5% was observed for total seed weight (totalwgseeds), number of filled seeds (nrfilledseed), fill rate (fillrate) and harvest index (harvestindex).

In addition, plants expressing an AP2/ERF nucleic acid showed to have increased biomass, such as maximum height, early vigour and total root biomass (results not shown).

TABLE E3

Data summary for transgenic rice plants expressing an AP2/ERF nucleic acid encoding the AP2/ERF polypeptide of SEQ ID NO: 160 under drought-stress conditions.

| Parameter | Overall |
|---|---|
| totalwgseeds | 33.2 |
| fillrate | 55.2 |
| harvestindex | 50.1 |
| nrfilledseed | 38.5 |

For each parameter the overall percent increase is shown (p-value <0.05).

11.4 TPS, TPP and TPS-TPP Polypeptide

Performance of rice plants transformed with the vectors pGOS2:: A.thaliana_DNTPS1-TPPB, pGOS2::S.cerevisiae_TPS1/TPS2_fusion and pS.cerevisiae_TPS1/TPS2_fusion under the nitrogen deficiency screen was evaluated according to procedures described in the examples herein. The results are presented in Table E4.

| Promoter | GOS2 | GOS2 | GOS2 |
|---|---|---|---|
| Gene | A.thaliana_DNTPS1-TPPB | (TPS1/TPS2 Fussion S.c.) | (Chl-Rbc-ScTPS1/ScTPS2) |
| Sub-cellular targeting | No | No | chloroplastic |
| Yield related trait | % increase in transgenic plant compared to control plant (Overall %) | % increase in transgenic plant compared to control plant (Overall %) | % increase in transgenic plant compared to control plant (Overall %) |
| AreaMax | 18.5 | 19.4 | 8.4 |
| EmerVigor | 14.1 | 6.3 | ND |
| Timetoflower | ND | ND | 3.16 |
| RootMax | 12.9 | 4.8 | ND |

-continued

| Promoter | GOS2 | GOS2 | GOS2 |
|---|---|---|---|
| totalwgseeds | 37.2 | ND | 15.9 |
| nrtotalseed | 40.2 | 27.2 | 22.4 |
| nrfilledseed | 45.6 | ND | 20.5 |
| firstpan | ND | ND | 20.4 |
| flowerperpan | ND | 16.0 | ND |

Areamax: above ground biomass of a plant which is indicative of the leaf biomass. It is measured as the maximum of area (in $mm^2$ from the digital pictures) covered by leafy biomass in the life span of a plant, based on the asymptote of the curve fitting or, if the fit is not satisfactory, based on the absolute maximum.

EmerVigor: indication of the seedling vigour. The area (in $mm^2$ from the digital pictures) covered by leafy biomass at 2-3 weeks post germination.

Firstpan: the number of panicles in the first floral flush.

Flowerperpan: a calculated parameter estimating the average number of florets per panicle on a plant (nrtotalseeds/firstpan).

Nrfilledseed: number of filled seeds of a plant.

Nrtotalseed: number of florets of a plant (empty seeds+ filled seeds).

RootMax: indication of the total root biomass. Maximum biomass of roots observed during the lifespan of a plant (obtained from the digital images).

TimetoFlower: The time (in days) between sowing and the emergence of the first panicle.

Totalwgseeds: Indication of the yield per plant (in g).

SEQUENCE LISTING (526 sequences)

SEQ ID NO: 1 - DNA, 2352 bp, Oryza sativa
atggaggaggagcagagcccgaggctcgccgccggcgagccggagcgcaagctcgaggacggagtcaccgacgccgaggaccccgggtgcacgggcaatgcggccatgagctcgctggagcagccgcttctgaagcggagcaacacgctaacggccagccacctcgccatggttggcgccaaggtctcccacatcgagagcctcgactacgaaattatcgagaatgatctgttcaagcacgactggaggaggcgatcgaacgtggaggtgctgcagtacatcttcctcaagtgggccatggcgttcctcgtcggcctcctcaccggcgtcatcgcgtcgctcatcaacctcgccatcgagaacatctccggcctcaagatgctccacatggtgcagctcgtccgcaagaaaagatactgggccggtttcttgtatttcgccggcgtcaacttcggcctgacgttcatcgccgccatgctctgcgtcgtcttcgccccgaccgccgccggccccggcatcccggagatcaaggcctacctcaacggcgtcgacacgcccaacatgttcggcgcgccgcagctcattgtcaagatcatcggtagcatctgcgcggtgtcgtcggggctggatctcgggaaggaagggccactggtgcacatcggcgcgtgcctggcgaacttgctgagccagggcggctccggccggcaccgcctccggttgcggtggctgcgctacttcgacaacgaccgcgaccggcgcgacctgatcacctgcggcgcgtcatcgggcgtgtgcgcggcgttccgggcgcccgtcggcggcgtgctgttcgcgctggaggaggtggcgacgtggtggcggagcgcgctgctgtggcgcaccttcttcagcacggccaccgtcgtcgtcgtcctccgcgggttcatcgaggtgtgcaggaacgggcggtgcggtctgttcggcgagggcgggctcatcctgttcgacgtcggcgacgtcgccgtccggtaccacgccggcgacctcctcccggtgaccatcgtcggcgtgcttggcggcgtcctcggcgcgctgtacaaccacgtcctccacaaggtgctccgcgtgtacaacctcatcaacgagaagggccgcgccgcgaagctcgccctggcgctcgccgtgtgcgcgctcacgtcggcgctgctgtacgtgacgccgttcgccgtgccgtgcacgccgtgcgacccggcgttcggcggcgcgtgcccgacgctggggaagagcggcaacttcaagcggttcaactgccccgagggccactacaacgacctcgccaccctcctccacgccaccaacgtcgacgcgacgcggaacatcttctccacgggcaccgccggcgagttcaggctcgactcgctgctcatcttcttcgccgtctactgcgtcctgggcctcttcaccttcggcatcgccgtcccctcggggctcttcctccccatcatcctcatgggctccgcctacggccgcgtcacggcgctcgtgctgtcgcggttcgcccgcatcgaccacggcctatacgccgtgctcggcgcggcggcgctcatgtcggggtccatgcggatgaccgtgtcgctcgtcgtcatcttcctcgagctcaccaacaacctcctcctcctcccaatcaccatgttcgtcctcctcatcgccaagaccgtcggcgacgcgttcaaccccagcatctacgagatcatcctcgacctcaagggcctcccgttcctggaggcgaagccggagccgtggatgaaggacctcaccgtcggcgagctcgccgccgccaagccccgcgccgtggcgctccaggtggtggagcgcgtgtccacggtggtggaggcgctccgggcgacgcggcacaacgggttcccggtgctggaccggccgcggcccggggtatcggagctgcacgggctggtgctccggtcgcacctcgtcgccgcgctgaggaagcggtggttcctgccggagaggaggaggacggaggagtgggaggcccgcgagatgttcagctcggcggagctcgcggacaagtgcggcggcgtggacgagctggagatctcgccggaggagatggggatgtacgtggacctccacccgctgacgaacacgacgccgtacaccgtggtggagaccatgtcggtggcgaaggccgtcgtgctgttccgctccgtcgcgctccgccacatgctcatcatgcccaagttccaaggacccgagatatctccaattgtggggatcttgacaaggcaggacctgatagcacacaacatcctcggtgcatttccacaccttgcaagcaagaggaaaacacattga

SEQ ID NO: 2 - protein, 783 aa, Oryza sativa
MEEEQSPRLAAGEPERKLEDGVTDAEDPGCTGNAAMSSLEQPLLKRSNTLTASHLAMVGAKVSHIESLDYEIIENDLFKHDWRRRSNVEVLQYIFLKWAMAFLVGLLTGVIASLINLAIENISGLKMLHMVQLVRKKRYWAGFLYFAGVNFGLTFIAAMLCVVFAPTAAGPGIPEIKAYLNGVDTPNMFGAPQLIVKIIGSICAVSSGLDLGKEGPLVHIGACLANLLSQGGSGRHRLRLRWLRYFDNDRDRRDLITCGASSGVCAAFRAPVGGVLFALEEVATWWRSALLWRTFFSTATVVVVLRGFIEVCRNGRCGLFGEGGLILFDVGDVAVRYHAGDLLPVTIVGVLGGVLGALYNHVLHKVLRVYNLINEKGRAAKLALALAVCALTSALLYVTPFAVPCTPCDPAFGGACPTLGKSGNFKRFNCPEGHYNDLATLLHATNVDATRNIFSTGTAGEFRLDSLLIFFAVYCVLGLFTFGIAVPSGLFLPIILMGSAYGRVTALVLSRFARIDHGLYAVLGAAALMSGSMRMTVSLVVIFLELTNNLLLLPITMFVLLIAKTVGDAFNPSIYEIILDLKGLPFLEAKPEPWMKDLTVGELAAAKPRAVALQVVERVSTVVEALRATRHNGFPVLDRPRPGVSELHGLVLRSHLVAALRKRWFLPERRRTEEWEAREMFSSAELADKCGGVDELEISPEEMGMYVDLHPLTNTTPYTVVETMSVAKAVVLFRSVALRHMLIMPKFQGPEISPIVGILTRQDLIAHNILGAFPHLASKRKTH

SEQ ID NO: 3 - DNA, 2343 bp, Arabidopsis thaliana
atggtggaagaagatttaaaccagattggtggtaatagtaattacaatggagaaggaggcgacccagagagcaacacacttaaccaacctctagttaaggctaatcgaacactttcttcaactccacttgctttggttggtgccaaagtttcccatatcgaaagcttggactatgaaataaacgagaacgatctgtttaagcatgattggagaaaaagatcaaaggcacaagtacttcaatacgtgttcttgaaatggacgttagcttgtcttgttggtcttttcactggtttaatcgctactctcatcaacttagctgttgaaaacatcgccggctataagcttttagccgttggtcacttcctcactcaagaaagatatgttacaggtctgatggtgcttgttggggcgaatttgggactgacgttggtggcgtctgtgctttgtgtgtgctttgctcctacggcggctggacctggaatccctgagatcaaagcttatcttaatggtgtagatactcccaacatgtttggtgctactactatgatcgttaagattgttggaagcattggagcggttgcagctggacttgatctaggtaaagagggtcctctagttcacattggaagctgcatagcttctttgcttggacaaggtggaacagacaaccaccgtatcaagtggcggtggcttcgttacttcaacaacgatagagaccgcagggatctgattacatgtggctcagctgcaggagtgtgtgcagccttcaggtcacctgttggaggtgtacttttcgccctcgaggaagttgctacttggtggagaagtgccttattgtggcggactttcttcagcacagcggttgttgtggttgttctaagagagttcatagagatctgcaattcagggaagtgtgggttgtttggaaaaggagggctaatcatgtttgatgtgagtcatgtaacttatacttaccatgtaactgatataatccctgtcatgttgattggtgtaatcggtggaattcttgggagcctgtacaatcatcttctgcataaagttctcaggctttacaatctcatcaatgagaagggtaagatccataaggtgcttctcagtcttacagtatcactctttacatctgtttgcctttatggccttcctttcttagcgaaatgcaagccttgtgacccctcgatagatgagatatgcccgacgaatggaagatcgggtaacttcaaacagttccattgccctaaaggttactacaatgatctagctactctgcttctcaccaccaacgatgatgctgtcagaaaccttttctcttccaacactcccaatgagtttggtatgggttccctttggatattctttgtgctatactgcatcttggggcttttcacatttggtattgcaacaccgtctggtctcttcctccccatcatcctcatgggtgctgcatatggccgaatgcttggcgctgcaatgggatcatacacaagtattgaccaagggctttatgctgtccttggtgcagctgcactcatggctggatcgatgagaatgactgtgtcactctgtgttatattccttgaactcaccaacaaccttcttttgcttcctataacgatgatcgtgcttctgatagccaaaactgtgggagacagctttaacccgagtatatatgacatcatcttgcatctaaagggcttacctttcttagaagcaaatccagagccgtggatgaggaacctcaccgttggtgagcttggtgatgctaagcccccggttgtaaccctgcaaggtgttgaaaaggtttcaaatatagttgatgtgctaaagaacacgacgcataatgcattccctgttttagatgaagcagaagtacctcaagtgggtctagcaactggggctacagaactccacgggttgatcttgagagcgcacctcgttaaagttctgaaaaagagatggttcttgacagagaaaagaagaacagaggagtgggaggtcagagaaaagtttccatgggatgaattggctgaaagagaagacaactttgacgacgtggccatcacaagcgctgaaatggaaatgtatgtcgatcttcatcctctcaccaacacaacaccttacacagtcatggagaacatgtcagtggccaaggctttagtacttttccggcaagtgggactccggcatttgcttattgttcccaagattcaagcctcaggaatgtgtcctgtggtagggatcttaaccagacaggacctaagggcatacaacattctacaagcctttcctctcttggaaaaatccaaaggtggaaagacacattga

SEQ ID NO: 4 - protein, 780 aa, Arabidopsis thaliana
MVEEDLNQIGGNSNYNGEGGDPESNTLNQPLVKANRTLSSTPLALVGAKVSHIESLDYEINENDLFKHDWRKRSKAQVLQYVFLKWTLACLVGLFTGLIATLINLAVENIAGYKLLAVGHFLTQERYVTGLMVLVGANLGLTLVASVLCVCFAPTAAGPGIPEIKAYLNGVDTPNMFGATTMIVKIVGSIGAVAAGLDLGKEGPLVHIGSCIASLLGQGGTDNHRIKWRWLRYFNNDRDRRDLITCGSAAGVCAAFRSPVGGVLFALEEVATWWRSALLWRTFFSTAVVVVVLREFIEICNSGKCGLFGKGGLIMFDVSHVTYTYHVTDIIPVMLIGVIGGILGSLYNHLLHKVLRLYNLINEKGKIHKVLLSLTVSLFTSVCLYGLPFLAKCKPCDPSIDEICPTNGRSGNFKQFHCPKGYYNDLATLLLTTNDDAVRNLFSSNTPNEFGMGSLWIFFVLYCILGLFTFGIATPSGLFLPIILMGAAYGRMLGAAMGSYTSIDQGLYAVLGAAALMAGSMRMTVSLCVIFLELTNNLLLLPITMIVLLIAKTVGDSFNPSIYDIILHLKGLPFLEANPEPWMRNLTVGELGDAKPPVVTLQGVEKVSNIVDVLKNTTHNAFPVLDEAEVPQVGLATGATELHGLILRAHLVKVLKKRWFLTEKRRTEEWEVREKFPWDELAEREDNFDDVAITSAEMEMYVDLHPLTNTTPYTVMENMSVAKALVLFRQVGLRHLLIVPKIQASGMCPVVGILTRQDLRAYNILQAFPLLEKSKGGKTH

SEQ ID NO: 5 - DNA, 2379 bp, Arabidopsis thaliana
atgttatcgaatcatctccagaacgggatcgaatccgataacctactctggtctcgtgtccctgaatccgatgatacttccaccgacgatattactctactcaactctcaccgtgacggtgacggaggtgtcaatagtctcgattacgaagtcatcgagaattacgcttatagagaagaacaagctcatcgaggaaagctttatgttggttactacgttgctgtcaaatggttcttctctttactcatcgggatcggaactggattagctgctgtgttcatcaatctctctgttgagaatttcgctggatggaaatttgctcttacttttgctattattcagaagtcgtattttgctgggtttattgtttatcttctcatcaatttagtcttagtgttttcttctgcgtatattattactcaatttgctcctgctgctgctggttctggcattcctgagattaagggttatctcaatggaattgatattcccggcaccttgctctttagaactctcattggaaagatatttggaagcattggttctgttgggggtggcttagccttggggaaagaaggtcctcttgtgcatacaggtgcctgcattgcatcgttgcttggtcagggtggatctacgaaatatcatttgaattctagatggccgcaactttttaagagtgatagagatcggcgtgatcttgtcacttgtggatgtgcagctggagttgctgctgcctttagagccccagttggtggagtgttatttgcattagaggaggtcacatcatggtggagaagtcaacttatgtggcgtgtctttttcacttccgctattgtggctgttgttgtgcgtactgccatgggatggtgcaagagtggaatatgtggacattttggtggaggtggtttcattatatgggatgtatcagatggtcaagatgactactacttcaaagagctactgccaatggctgtaataggagttatcggagggctacttggggcattatttaaccaacttacactctatatgacatcttggcgtcggaactctttgcacaagaaaggaaatcgagtgaagataattgaagcatgcatcatctcttgtataacttcagctatctcatttgggctgccactcctaagaaaatgcagtccatgccctgaatcagttcctgactctggtattgagtgtccacgacctccaggaatgtatggaaattatgtaaatttcttctgcaagacggataacgaatacaatgatctcgctacaattttcttcaatactcaggatgatgctataaggaatttgttcagcgcaaaaacaatgcgagagttcagtgctcagagtctactaacttttctggctatgttttacacattagctgtagtgacctttggcactgctgttcccgccggccagtttgttcctggaataatgataggatcaacttatgggcgccttgtaggcatgtttgtggtcaggttttataagaagctcaacattgaggagggaacttatgctttgctgggagctgcttcatttctcggaggctcgatgcggatgactgtatctttatgtgttatcatggttgaaatcacaaataacctgaaacttctgcctcttataatgttggtacttctcatctcaaaggccgtcggtgatgctttcaatgagggattatatgaagtacaagcacgcctgaagggcattccgttacttgaatcgagacctaagtatcacatgcgtcaaatgatagcaaaggaagcgtgtcaaagtcagaaggtaatctctttacctcgagttatcagggtcgcagatgttgcttcaattttgggcagcaataaacataatggatttcctgtaatcgaccacacgagaagtggtgaaacacttgtcatagggttagtccttcggagtcacttgcttgttctccttcaatcaaaagtcgatttccaacatagtcctttgccttgtgatccaagtgccaggaatatcaggcacagttttagcgagtttgctaaacctgtttcatcgaaagggttatgcatagaagatatacatttaacttcagatgatttagagatgtacatagatcttgctccatttttgaatccgtctccatacgttgttcccgaagacatgtccttgacaaaggtatacaatcttttccggcaacttgggttgcgacatctattcgttgttccccgtccttcccgtgtgataggcttgatcaccagaaaggatttactgattgaggaaaatggggaatcatcagcagtggaactccaacagtcaactagtgtaagaggtcggtacagtgagacagcaacgcggatggacgctgcacgaccgcttctagacgatcttttaggttaa

SEQ ID NO: 6 - protein, 792 aa, Arabidopsis thaliana
MLSNHLQNGIESDNLLWSRVPESDDTSTDDITLLNSHRDGDGGVNSLDYEVIENYAYREEQAHRGKLYVGYYVAVKWFFSLLIGIGTGLAAVFINLSVENFAGWKFALTFAIIQKSYFAGFIVYLLINLVLVFSSAYIITQFAPAAAGSGIPEIKGYLNGIDIPGTLLFRTLIGKIFGSIGSVGGGLALGKEGPLVHTGACIASLLGQGGSTKYHLNSRWPQLFKSDRDRRDLVTCGCAAGVAAAFRAPVGGVLFALEEVTSWWRSQLMWRVFFTSAIVAVVVRTAMGWCKSGICGHFGGGGFIIWDVSDGQDDYYFKELLPMAVIGVIGGLLGALFNQLTLYMTSWRRNSLHKKGNRVKIIEACIISCITSAISFGLPLLRKCSPCPESVPDSGIECPRPPGMYGNYVNFFCKTDNEYNDLATIFFNTQDDAIRNLFSAKTMREFSAQSLLTFLAMFYTLAVVTFGTAVPAGQFVPGIMIGSTYGRLVGMFVVRFYKKLNIEEGTYALLGAASFLGGSMRMTVSLCVIMVEITNNLKLLPLIMLVLLISKAVGDAFNEGLYEVQARLKGIPLLESRPKYHMRQMIAKEACQSQKVISLPRVIRVADVASILGSNKHNGFPVIDHTRSGETLVIGLVLRSHLLVLLQSKVDFQHSPLPCDPSARNIRHSFSEFAKPVSSKGLCIEDIHLTSDDLEMYIDLAPFLNPSPYVVPEDMSLTKVYNLFRQLGLRHLFVVPRPSRVIGLITRKDLLIEENGESSAVELQQSTSVRGRYSETATRMDAARPLLDDLLG

SEQ ID NO: 7 - DNA, 2292 bp, Arabidopsis thaliana
atgccaaactcaacgacggaggactccgtcgccgttccactactcccctccctccgccgcgctactaactctacttctcaagtagcaatcgtcggtgccaacgtctgtccaatagaaagtctcgattacgaaatcgcggagaatgatttcttcaagcaggattggagaggtcgtagtaaggtagagattttccaatacgtgtttatgaagtggctgctttgtttttgtatcggcattattgttagtctcatcggattcgctaataacctcgccgttgagaatctcgccggtgttaagtttgttgttacttctaacatgatgatagccggaaggtttgctatgggttttgttgttttctctgttacaaatttgattcttactctctttgcgtcggtgattaccgcttttgttgctcctgctgcggcaggttccggtataccggaagttaaggcttatttgaatggtgttgatgctccagagatattctcacttcgcactttgatcattaagatcattgggaacatatctgcagtatcagcgtctcttctcattggaaaggcagggcctatggtgcatactggtgcttgtgttgcatctatacttggtcagggtggctccaaaagatatagattgacctggagatggctcagatttttcaaaaatgatagagacagaagagatcttgtaacttgtggggcagctgctggtatcgctgcttcgtttcgtgctccggttggtggtgtcctgtttgcgcttgaggaaatgtcatcttggagtgcacttttatggagaatcttcttttcgacagctgttgtggcaatagttctcagagctctaatcgatgtgtgtttaagtggaaagtgtgggttatttggtaaaggaggcttaataatgtttgatgtctactcagaaaatgcgtcatatcatttaggggatgtacttcctgttcttcttcttggggttgttggtggtattttaggaagcttatacaacttcttactggataaggttctgcgagcttacaactacatatatgagaaaggggttacttggaaaatcctcctcgcttgtgcgatatcgattttcacgtcctgccttcttttcggattaccatttcttgcatcatgccaaccttgtcctgtcgatgccttagaggagtgccctacaattggacggtctggaaactttaagaaataccaatgccctcctggtcactacaatgatctagctagccttattttcaacacaaatgatgatgccatcaaaaaccttttcagcaaaaacactgacttcgagtttcattatttttcggttctcgtattttttgtcacctgcttcttcctcagtatctttagctatggcattgttgctccagcagggctctttgtgccagttattgtaacaggagcatcgtatggacggtttgtagggatgctgcttggttcaaactcaaatcttaatcatggtctgtttgctgtgctcggtgctgcatcctttcttggcggaacaatgaggatgacagtttccacttgtgttattctccttgagctgaccaacaatctgctgctactacctatgatgatggtggtccttctgatttcaaaaacagttgctgatggtttcaatgctaacatctacaacctcatcatgaagttaaaaggatttccctacctctacagccatgcagagccttacatgaggcagcttctagttggtgatgtagtcaccggcccacttcaagtcttcaatggcattgagaaagtcgagactattgtacacgttctcaaaacgaccaatcacaatggcttccccgtggttgatgggccaccactagctgcagctcctgttctacacggtctaatcctccgggctcatattctgactctgttaaagaaacgagtattcatgcctagtccagtagcttgtgactccaataccctttcccaattcaaggcagaggagtttgctaagaagggttctgggaggagtgataagatagaagatgtggaattaagcgaggaagaattgaatatgtatttggatttgcacccattctctaatgcctctccgtacactgttgtggagacaatgtcacttgcaaaggcccttattctcttccgtgaggttggcataaggcacttactggttataccaaaaacctccaatagacctccagtggtaggtatattgacacggcatgacttcatgccggaacatatactaggcctgcatccctccgtttctcggagcaagtggaaaaggcttcggattcggctgcctttcttctcatga

SEQ ID NO: 8 - protein, 763 aa, Arabidopsis thaliana
MPNSTTEDSVAVPLLPSLRRATNSTSQVAIVGANVCPIESLDYEIAENDFFKQDWRGRSKVEIFQYVFMKWLLCFCIGIIVSLIGFANNLAVENLAGVKFVVTSNMMIAGRFAMGFVVFSVTNLILTLFASVITAFVAPAAAGSGIPEVKAYLNGVDAPEIFSLRTLIIKIIGNISAVSASLLIGKAGPMVHTGACVASILGQGGSKRYRLTWRWLRFFKNDRDRRDLVTCGAAAGIAASFRAPVGGVLFALEEMSSWSALLWRIFFSTAVVAIVLRALIDVCLSGKCGLFGKGGLIMFDVYSENASYHLGDVLPVLLLGVVGGILGSLYNFLLDKVLRAYNYIYEKGVTWKILLACAISIFTSCLLFGLPFLASCQPCPVDALEECPTIGRSGNFKKYQCPPGHYNDLASLIFNTNDDAIKNLFSKNTDFEFHYFSVLVFFVTCFFLSIFSYGIVAPAGLFVPVIVTGASYGRFVGMLLGSNSNLNHGLFAVLGAASFLGGTMRMTVSTCVILLELTNNLLLLPMMMVVLLISKTVADGFNANIYNLIMKLKGFPYLYSHAEPYMRQLLVGDVVTGPLQVFNGIEKVETIVHVLKTTNHNGFPVVDGPPLAAAPVLHGLILRAHILTLLKKRVFMPSPVACDSNTLSQFKAEEFAKKGSGRSDKIEDVELSEEELNMYLDLHPFSNASPYTVVETMSLAKALILFREVGIRHLLVIPKTSNRPPVVGILTRHDFMPEHILGLHPSVSRSKWKRLRIRLPFFS

SEQ ID NO: 9 - DNA, 2328 bp, Arabidopsis thaliana
atggatgaagatggaaacttgcagattagtaatagtaattacaatggagaagaagaaggagaagatccagagaacaacactttgaatcaaccactgcttaagagacatagaactctttcttcaactcctcttgctttggtcggtgccaaggtttcacacatcgagagtttagattatgaaataaacgagaatgatctgttcaagcatgactggagaagcagatcaaaagcacaagtgtttcaatacatattcttaaaatggacattagcttgtcttgttggtctcttcactggtcttatcgctactctcatcaaccttgctgtcgaaaacatcgccggttacaaacttctcgccgtcggctactacattgctcaagataggttttggacaggtctgatggtctttacgggggcgaatttgggtctgactttggtggcgacagtacttgttgtttactttgctcctacggcggctggtccggggatccctgagattaaagcttaccttaatggcattgacactcccaatatgtttggttttaccaccatgatggttaagattgttggaagtattggagcggttgcagctggacttgatcttggtaaagaagggccattggttcatattggaagttgcatagcttctttgcttggtcaaggtggtccagataatcacagaatcaaatggagatggcttcgttacttcaacaacgatagagatcgaagagatcttattacatgtggatctgcctctggagtatgtgctgctttcaggtcaccagtaggaggagtacttttcgctcttgaggaagtcgctacgtggtggagaagcgctctcttgtggagaacattcttcagtacagccgttgtggtggttgtattaagagcgttcattgagatttgtaactccgggaaatgcggacttttcggctcaggaggactcattatgttcgatgtgagtcatgtagaggttaggtaccacgcagcagatataatcccagtcacattgattggagtctttggtggcattcttggaagcttgtacaatcatcttctgcataaagttctccggctttacaatctcatcaaccagaagggaaagattcataaggtgcttctaagtcttggggtatctctattcacatcagtttgcttgttcggtcttcctttcttagcggaatgcaagccttgtgatccttctatagacgagatatgtccaacaaacggaagatcaggaaatttcaagcaattcaactgtccaaatggttattacaacgatctatccactctgcttctcacaaccaatgatgatgcagtcagaaacattttctcttcaaacactcctaatgagtttggcatggtttctctctggatattctttggcctctactgcattttgggtcttataacattcggtatagcgacaccgtcgggtctcttcctaccgattatcctcatgggttctgcatacggtaggatgctaggcacagcaatggggtcttacacaaacatagatcaagggctttacgcggttcttggtgcagcttcactcatggctggttcaatgagaatgactgtttcactctgtgttatatttctggaactcaccaacaaccttcttttgttgcccattacaatgtttgtgcttctgatagctaaaacagtaggtgacagcttcaatctaagtatctacgagatcattctccatcttaagggcttacctttcttggaagcaaatccagagccgtggatgaggaatctcactgtaggtgagcttaacgacgctaagcctccggttgtaacacttaacggagtagaaaaagtggcaaatatagtcgatgtactaaggaacacaacgcataacgcattcccagtcttggatggagcagatcaaaacactggcacagagctccatggtctgatcctaagagctcaccttgtgaaagttctgaaaaagagatggttcttgaatgagaaaaggagaacagaagagtgggaagttagggaaaagttcacaccggttgaattagctgagagagaagataacttcgatgatgttgcaatcacaagctcagagatgcaattgtatgttgatcttcatcctttgaccaacactacaccttacacagtggtgcaaagtatgtcagtggctaaagctttggttctgttccggtcagtgggtctcagacatttactggtggttcccaagattcaagcttcagggatgtcacctgtgatagggatcttaacaaggcaagatctcagggcttataacattctacaagcatttcctcacttggataaacacaaaagtggaaaagctagatga

SEQ ID NO: 10 - protein, 775 aa, Arabidopsis thaliana
MDEDGNLQISNSNYNGEEEGEDPENNTLNQPLLKRHRTLSSTPLALVGAKVSHIESLDYEINENDLFKHDWRSRSKAQVFQYIFLKWTLACLVGLFTGLIATLINLAVENIAGYKLLAVGYYIAQDRFWTGLMVFTGANLGLTLVATVLVVYFAPTAAGPGIPEIKAYLNGIDTPNMFGFTTMMVKIVGSIGAVAAGLDLGKEGPLVHIGSCIASLLGQGGPDNHRIKWRWLRYFNNDRDRRDLITCGSASGVCAAFRSPVGGVLFALEEVATWWRSALLWRTFFSTAVVVVVLRAFIEICNSGKCGLFGSGGLIMFDVSHVEVRYHAADIIPVTLIGVFGGILGSLYNHLLHKVLRLYNLINQKGKIHKVLLSLGVSLFTSVCLFGLPFLAECKPCDPSIDEICPTNGRSGNFKQFNCPNGYYNDLSTLLLTTNDDAVRNIFSSNTPNEFGMVSLWIFFGLYCILGLITFGIATPSGLFLPIILMGSAYGRMLGTAMGSYTNIDQGLYAVLGAASLMAGSMRMTVSLCVIFLELTNNLLLLPITMFVLLIAKTVGDSFNLSIYEIILHLKGLPFLEANPEPWMRNLTVGELNDAKPPVVTLNGVEKVANIVDVLRNTTHNAFPVLDGADQNTGTELHGLILRAHLVKVLKKRWFLNEKRRTEEWEVREKFTPVELAEREDNFDDVAITSSEMQLYVDLHPLTNTTPYTVVQSMSVAKALVLFRSVGLRHLLVVPKIQASGMSPVIGILTRQDLRAYNILQAFPHLDKHKSGKAR

SEQ ID NO: 11 - DNA, 2340 bp, Arabidopsis thaliana
atggatgatcggcacgaaggagaccatcatgatatagaggttgaaggaggagctttacatggtttcgagaggaagatatctgggattctagacgatggatctgtcggatttcgacagcctcttctcgctaggaatcgaaagaacacaacttctcagatcgctattgtcggagctaatacttgtcccatcgaaagccttgattacgagatcttcgaaaatgattttttcaagcaagactggaggtctaggaagaagattgagatacttcagtatacgtttctcaaatgggcgcttgcttttcttattggtttagctactggacttgttggctttttgaataaccttggtgttgagaatatagctggatttaaactcttgctcatcggtaatctcatgctcaaggaaaaatatttccaggcattttttgcatttgctggttgtaacttaattttggcaactgctgctgcttcactctgtgcttttattgctcctgcggcggcaggatctggcatacctgaggttaaagcatatctcaatggtatagatgcttattcaatattagctccaagcaccctctttgttaagatctttggctctatatttggagttgctgccggatttgtagttggaaaagaagggcctatggttcatactggtgcttgcattgctaatttacttggacaaggtggttccaaaaagtaccggttgacttggaagtggctcagattcttcaaaaacgatagagacagaagagacctgatcacttgcggggctgctgctggtgtagcagctgccttccgtgctccagttggaggagtgcttttcgcccttgaagaagctgcttcatggtggaggaatgcccttctctggaggacattcttcactaccgcagttgtagcagtggtcttacgaagtttgattgagttctgtcgctctgggagatgtggactgtttgggaaaggaggtctcatcatgtttgatgtaaactcgggaccagtgctatatagcactccagatttgctagcaatagtattccttggagttattggtggtgtgcttggaagcctttacaactaccttgtggacaaagtcctccgcacatatagcattataaacgagaaaggtccgagatttaaaattatgcttgtaatggcagtttccattttgagctcgtgttgcgcatttggtctcccatggctttcacagtgtactccatgtcctattggcatagaggagggaaagtgccctagtgtaggtcgatccagcatctataagagtttccagtgtcctccaaaccattacaatgacctttcctccctacttctcaacaccaatgatgatgcaatccgtaatcttttcacatccagatctgaaaatgaattccatatctctacccttgccatcttctttgtcgcagtgtactgccttggcatcataacatacggcatagccataccctctgggcttttcattcctgtcattcttgctggagcctcttatggacgactagtgggtagactgctgggtccagtatctcagcttgatgtaggtctgttttctctgctcggagctgcttccttccttggaggcacaatgagaatgacggtctctctatgtgttatactgctcgaacttacaaataatctcctaatgctgccactggtgatgcttgtactccttatatcaaaaacggttgcagattgtttcaacaggggggtctatgaccagattgtaacaatgaaaggactgccttacatggaagaccatgcagagccgtacatgcgcaatttggttgcaaaggacgtagtttctggagctttgatatccttttcgagagttgaaaaggttggggtaatatggcaggctttaaaaatgacaagacataatggtttccctgtaattgatgagccacctttcacagaagcttctgagctatgtgggattgccttgagatctcatctccttgtgcttctccaagggaagaaattctcgaagcagagaacaacttttggttcacaaattctgagaagttgcaaagcccgtgactttggtaaagcagggttaggtaaggggctcaagattgaagatttggatctaagtgaggaggagatggagatgtatgttgatctccatcccatcactaacacatctccttacactgtgcttgagactctgtctctagctaaggcggctattcttttccggcaacttggtcttcgccacttgtgtgtggtgcctaaaacaccagggagaccgcctattgttggaatactgacaaggcatgatttcatgccggaacatgtcctgggactctaccctcacattgatcccctcaagtga

SEQ ID NO: 12 - protein, 779 aa, Arabidopsis thaliana
MDDRHEGDHHDIEVEGGALHGFERKISGILDDGSVGFRQPLLARNRKNTTSQIAIVGANTCPIESLDYEIFENDFFKQDWRSRKKIEILQYTFLKWALAFLIGLATGLVGFLNNLGVENIAGFKLLLIGNLMLKEKYFQAFFAFAGCNLILATAAASLCAFIAPAAAGSGIPEVKAYLNGIDAYSILAPSTLFVKIFGSIFGVAAGFVVGKEGPMVHTGACIANLLGQGGSKKYRLTWKWLRFFKNDRDRRDLITCGAAAGVAAAFRAPVGGVLFALEEAASWWRNALLWRTFFTTAVVAVVLRSLIEFCRSGRCGLFGKGGLIMFDVNSGPVLYSTPDLLAIVFLGVIGGVLGSLYNYLVDKVLRTYSIINEKGPRFKIMLVMAVSILSSCCAFGLPWLSQCTPCPIGIEEGKCPSVGRSSIYKSFQCPPNHYNDLSSLLLNTNDDAIRNLFTSRSENEFHISTLAIFFVAVYCLGIITYGIAIPSGLFIPVILAGASYGRLVGRLLGPVSQLDVGLFSLLGAASFLGGTMRMTVSLCVILLELTNNLLMLPLVMLVLLISKTVADCFNRGVYDQIVTMKGLPYMEDHAEPYMRNLVAKDVVSGALISFSRVEKVGVIWQALKMTRHNGFPVIDEPPFTEASELCGIALRSHLLVLLQGKKFSKQRTTFGSQILRSCKARDFGKAGLGKGLKIEDLDLSEEEMEMYVDLHPITNTSPYTVLETLSLAKAAILFRQLGLRHLCVVPKTPGRPPIVGILTRHDFMPEHVLGLYPHIDPLK

SEQ ID NO: 13 - DNA, 2406 bp, Glycine max
atgctgtccaatcatttccaaaacggcatcgaaacggcgaggctcgtttggtcgcggattcctaattcggaagaatcgcagctcctcgacgacgccgttggcatccttaagaagaacgacggaggcggtgtcgagagccttgactatgaagtcattgagaattttgcttatcgtgaggaacaggcgcagagggggaagctgtatgtgagctatttgctggtggtgaaatggttctttgccttgctcattggcatttgtacaggacttgctgctgttttcatcaatattgctgttgaaaattttgctggctggaagttctcagtgacatttaatataattcagaaatcatatattgctggatttgttgtatatgtcctgatcaacttggctttggtgttttcctctgtatatattatcacacaatttgcaccagcagctgctggatctggtattcctgaaatcaagggttacttaaatggagttgatattcatggcatccttcttttcagaactctaattggaaagatatttggaagcattggttcagtgggtggaggccttgctcttggtaaagaaggtcctcttgtccatactggtgcttgtattgcttctttgcttggacaaggtggatctactaagtatcatctaaattcgaggtggtttcaagtattcaaaagtgaccgggatcgtcgtgatcttgtaacctgtggatgtgcagctggagttgctgcagcatttagagctccagttggtggtgtattgtttgctttggaagaggttacatcttggtggaggagtcaactcatgtggcgtgtcttcttcacttcggctgttgtggctgttgtggtccgagctgcaatggggtggtgtaagagtggaaaatgtggacactttgggtccggtggattcataatttgggatatatcagatggtcaagaggattattcctttgcggagttatttccaatggctattattggggttattggaggcctactaggctctttattcaaccaacttacactttatattaccacttggcgtcgaaatcatcttcacaagaaagggaacagggtcaagattattgaagcatgccttgtatccattttaacatcagccatttcatttggcttgccacttctaagaaaatgtagtccttgccctgattctgatcctgcatctggtattgaatgtccaagacctcctggaatgtatgggaattatgtaaattttttttgtagcaaagacaaggaatacaatgatcttgcaactattttcttcaacacacaggatgatgccataaggaatttgttcagtgcaaaaacaataaatgaatacagttctcaaagtttattaacttttttggttatgttttatgcgttagctgtggtcacatttggtactgctgtgccagctggtcaatttgttcctggtataatgatagggtcaacatatgggcgtcttgttggcatgtttgttgtaaaatattacagaaagctcaacattgaagagggaacgtatgctttgctgggagctgcatcttttcttggaggctcaatgcggatgacagtatctctctgtgtcattatggttgaaatctcaaataacttaaaatttttacctcttattatgcttgttcttcttatatcgaaggctgttggtgatgcttttaacgaaggtatctatgaggagcaggctcaattgaggggcattccattactggaatcaagacctaaatatgagatgcggaatatgacagcaaaggaagcctgtggtagtggaagggtggtctctttccctcgtgttgttaaggtttcagacgtagtttccattctgcggagcaacaaacacaatggttttccagtgattgatcacacaagaagtggagaaccacttgttattggattagtgcttcgtagtcatttattggtaattctgcagtcaaaggttgatttccagcatagccctttaccctctgatcctagaggtgggggcagatcaattaggcatgattctggtgaatttgcaaagcctgtttctagtaaaggaatatgtattgatgatatacatttaagttcagatgacttagaaatgtacatcgatcttgctccgtttttgaatccctcaccatatattgtaccagaagatatgtctttgacaaaggtatacaatcttttccgtcaacttggtctacggcatttatttgttgttccccgcccatcacgtgtgcttggtttgataacaagaaaagatttgttgattgaggacaaggaaaatgtgaatacgttagagcttcagtcaactagtgtaagaattccgcatcagaataaaagattgatgacaagaaatatagatgtggagcaccctttgctaagcggactgcttcagaatcagatacctgactaa

SEQ ID NO: 14 - protein, 801 aa, Glycine max
MLSNHFQNGIETARLVWSRIPNSEESQLLDDAVGILKKNDGGGVESLDYEVIENFAYREEQAQRGKLYVSYLLVVKWFFALLIGICTGLAAVFINIAVENFAGWKFSVTFNIIQKSYIAGFVVYVLINLALVFSSVYIITQFAPAAAGSGIPEIKGYLNGVDIHGILLFRTLIGKIFGSIGSVGGGLALGKEGPLVHTGACIASLLGQGGSTKYHLNSRWFQVFKSDRDRRDLVTCGCAAGVAAAFRAPVGGVLFALEEVTSWWRSQLMWRVFFTSAVVAVVVRAAMGWCKSGKCGHFGSGGFIIWDISDGQEDYSFAELFPMAIIGVIGGLLGSLFNQLTLYITTWRRNHLHKKGNRVKIIEACLVSILTSAISFGLPLLRKCSPCPDSDPASGIECPRPPGMYGNYVNFFCSKDKEYNDLATIFFNTQDDAIRNLFSAKTINEYSSQSLLTFLVMFYALAVVTFGTAVPAGQFVPGIMIGSTYGRLVGMFVVKYYRKLNIEEGTYALLGAASFLGGSMRMTVSLCVIMVEISNNLKFLPLIMLVLLISKAVGDAFNEGIYEEQAQLRGIPLLESRPKYEMRNMTAKEACGSGRVVSFPRVVKVSDVVSILRSNKHNGFPVIDHTRSGEPLVIGLVLRSHLLVILQSKVDFQHSPLPSDPRGGGRSIRHDSGEFAKPVSSKGICIDDIHLSSDDLEMYIDLAPFLNPSPYIVPEDMSLTKVYNLFRQLGLRHLFVVPRPSRVLGLITRKDLLIEDKENVNTLELQSTSVRIPHQNKRLMTRNIDVEHPLLSGLLQNQIPD

SEQ ID NO: 15 - DNA, 2286 bp, Glycine max
atgggtgaggaatccagtttgcttaaagaaagcacatcaatcaatgacaccaatatggtggaagaggttgaagaaagggatccagaaagcaatccattgaatgagccacttctcaagaggaacaggactttgtcttccaatccacttgctcttgttggagcaaaagtttcctacatagaaagcttggactacgagatcaatgagaatgacctgttcaaacaagattggaggagcagatcaagaactcaagtgttgcaatacatattctggaaatggactctggcattccttgttggacttctcactggtgtcatagccactcttatcaatcttgctgttgagaacattgccgggtacaagtttcttgctgttgtcaactttatccaaaaagaaaggtacttgagaggtttcctatatttcacgggcattaatttccttttgacatttgttgcttctattctgtgtgtgtgttttgcacccacggcagctgggcctggaatacctgaaatcaaagcttatcttaatggtgttgatactcccaacatgtatggtgccaccacattgtttgttaagataattggaagcattggagctgtatctgcaggcctagatttaggaaaagaagggccattggccaaggaggccctgacaattacaggatcaagtggcgctggctacggtatttcaacaacgatcgtgaccgtcgcgatcttattacttgtggcacctgtgggaggagttctctttgctcttgaagaggtggcaacttggtggagaagtgctctcctctggagaacatttttcagcacagctgtggtggtggtagtgctaagggcctctattgaactttgccacaaaggcaagtgtggtctttttggtgaaggagggctcatcatgtatgatgtgagcgatgtcactgttaggtacaatgtgatggatatcatccctgttgttatcattggagtcctaggtggggtattgggaagcctttacaactatcttctccataaggtcctccgtgtctacaatctcatcaatcagaaaggaaaaatgtacaagctcctcctcagtctttcagttgcaatcttcacatcagcgtgccaatatggtctcccattcctagcaaaatgtaccccttgtgatccatccctctcagatgtgtgccccaccaacgggcgttctggaaacttcaaacaattcaactgcccaaaaggctactacaatgatcttgctactcttcttctgaccaccaatgatgatgctgttagaaacatattctcaaccaacacccctcttgaataccaaccctcctccatcataattttctttgcactgtattgcatactaggactaatcacctttgggattgctgtgccatcagggctcttcctccccatcattctcatgggttccggctacggtcgccttctcggcatcctcatggggcctcacacaaacattgatcaagggctgtttgcagtccttggtgcagcctcactcatggctggatccatgagaatgactgtgtccctttgtgtgatcttccttgaactaaccaacaaccttctcctactaccaataaccatgattgttctcctcatagctaaaactgttggagacagcttcaacccaagcatctatgagatcatattgcacctgaaaggcctccctttcatggatgcaaaccctgagccatggatgagaaacctcactgtgggtgagcttgttgatgtgaagccagcagtggttagcttcaaaggagtagaaaaggtggctaacatagtcaatgccttgaaaaacactacacataatggttttcctgtgatggattgtgggctggtgccaaccacaggagtggccaatgaggctacagaactgcacggaatcattctaagagcacaccttatccaagtgctgaagaagaagtggttcttgaaggagagaaggagaactgaggaatgggaagttagagagaaatttacatgggtggagctggctgagagagaagggaatattgaagatgtggctgtgacaaaagaagaaatggagatgtttgttgatttgcatcctctcaccaatactacacccttcacagtgctagagagtatgtcagttgcaaaagcaatggttctcttcagacaagtaggacttcgccatatgcttgttgtgccaaagtatcaagcttcaggggtatctcctgtgattgggatcctgacccggcaagatctactggcatacaacattctgacagtgtttcctcacctggcaaaatcaaagaggaagtga

SEQ ID NO: 16 - protein, 761 aa, Glycine max
MGEESSLLKESTSINDTNMVEEVEERDPESNPLNEPLLKRNRTLSSNPLALVGAKVSYIESLDYEINENDLFKQDWRSRSRTQVLQYIFWKWTLAFLVGLLTGVIATLINLAVENIAGYKFLAVVNFIQKERYLRGFLYFTGINFLLTFVASILCVCFAPTAAGPGIPEIKAYLNGVDTPNMYGATTLFVKIIGSIGAVSAGLDLGKEGPLAKEALTITGSSGAGYGISTTIVTVAILLLVAPVGGVLFALEEVATWWRSALLWRTFFSTAVVVVVLRASIELCHKGKCGLFGEGGLIMYDVSDVTVRYNVMDIIPVVIIGVLGGVLGSLYNYLLHKVLRVYNLINQKGKMYKLLLSLSVAIFTSACQYGLPFLAKCTPCDPSLSDVCPTNGRSGNFKQFNCPKGYYNDLATLLLTTNDDAVRNIFSTNTPLEYQPSSIIIFFALYCILGLITFGIAVPSGLFLPIILMGSGYGRLLGILMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPAVVSFKGVEKVANIVNALKNTTHNGFPVMDCGLVPTTGVANEATELHGIILRAHLIQVLKKKWFLKERRRTEEWEVREKFTWVELAEREGNIEDVAVTKEEMEMFVDLHPLTNTTPFTVLESMSVAKAMVLFRQVGLRHMLVVPKYQASGVSPVIGILTRQDLLAYNILTVFPHLAKSKRK

SEQ ID NO: 17 - DNA, 2406 bp, Glycine max
atgctggccaatcatttccaaaacggcatcgaaacggcgaggctcgtttggtcgcggattcctaattcggaagaatcgcagctcctcgacgacgccgttggcatccttaagaagaacgacggaggcggtgtcgagagccttgactatgaagtcattgagaattttgcttatcgtgaggaacaggcgcagagagggaagctgtatgtgagctatttgctggtggtgaaatggttctttgccttgctcattggcatttgtacaggacttgctgctgttgtcatcaatattgctgttgaaaattttgctggctggaagttctcagtgacatttaatataattcagaaatcatatattgctggatttgtcgtatatgtcctgatcaacttggctttggtgttttcctctgtatatattatcacacaatttgcaccagcagctgctggatctggtattcctgaaatcaagggttacttaaatggagttgatattcatggcatccttcttttcagaactttaattggaaagatatttggaagcattggttcagtgggtggaggccttgctctgggtaaagaaggtcctcttgtccatactggtgcttgtattgcttctttgcttggacaaggtggatctactaaatatcatctaaattcaaggtggtttcaagtattcaaaagtgaccgggatcgtcgtgatcttgtaacctgtggatgtgcagctggagttgctgcagcatttagagctccagttggtggtgtattgtttgctttggaagaggttacatcttggtggaggagtcaactcatgtggcgtgtcttcttcacctcggctgttgtggctgttgtggtccgagctgcaatggggtggtgtaagagtggaaaatgtggacactttgggtccggtggattcataatatgggatatatcagatggtcaagaggattattcctttgcagagttatttccaatggctattattggggttattggaggcctactaggctctttattcaaccagcttacactttatattaccacttggcgtcgaaatcatcttcacaagaaagggagcagggtcaagattattgaagcatgccttgtatccattttaacatcagccatttcatttggcttgccacttctaagaaaatgtagtccttgccctgattctgatcttgcatctggtattgaatgcccacgacctcctggaatgtatgggaattatgtaaattttttttgtagcaaagacaaggaatacaatgatctcgcaactattttcttcaacacacaggatgatgccataaggaatttattcagtgcaaaaacaataaatgagtacagttcccaaagtttattaacctttttggttatgttttatgcattagcagtgatcacgtttggtactgctgtgccagctggtcaatttgttcctggtataatgataggatcaacatatgggcgtcttgttggcatgtttgtcgtaaagtattacagaaggctcaacattgaagagggaacgtatgctttgctgggagctgcatcttttcttggaggctcaatgcggatgacagtatctctctgtgtcattatggttgaaatctcaaataacttaaaatttttacctcttattatgcttgttcttcttatatcgaaggctgttggtgatgcttttaacgaaggtatctatgaggagcaagctcaattgaggggcattccattactggaatcaaggcctaaatatgagatgcggaatatgacagcaaaggaagcctgtgggagtggaagggtggtctctttccctcgtgttgttaaggtttctgacgtagtttccattctgcggagcaacaaacacaatggttttccagtgattgatcacacaagaagtggagaaccacttgttattggattagtgcttcgtagtcatttattggtaattctgcagtcaaaggttgatttccagcatagccctttaccctctgatccaagaggtgggggcagatcaattaggcatgattctggtgaatttgcaaagcctgtttctagtaaaggaatatgtattgatgatatacatctaagttcagatgacttagaaatgtacattgatcttgctccatttttgaatccctcaccatatattgtaccagaagatatgtctttgacaaaggtatacaatcttttccgtcaacttggtcttaggcatttatttgttgttcctcgcccatcatgtgtggttggtttgataacaagaaaagatttgttgattgaggacaaagaaaatgtgaatacgttagagcttcagtcaactagtgtaagaattccgcaacagaataaaagattgatgacaagaaatatagatgtggagcgccctttgctaaacggactgcttcaaaatcagatacctgactaa

SEQ ID NO: 18 - protein, 801 aa, Glycine max
MLANHFQNGIETARLVWSRIPNSEESQLLDDAVGILKKNDGGGVESLDYEVIENFAYREEQAQRGKLYVSYLLVVKWFFALLIGICTGLAAVVINIAVENFAGWKFSVTFNIIQKSYIAGFVVYVLINLALVFSSVYIITQFAPAAAGSGIPEIKGYLNGVDIHGILLFRTLIGKIFGSIGSVGGGLALGKEGPLVHTGACIASLLGQGGSTKYHLNSRWFQVFKSDRDRRDLVTCGCAAGVAAAFRAPVGGVLFALEEVTSWWRSQLMWRVFFTSAVVAVVVRAAMGWCKSGKCGHFGSGGFIIWDISDGQEDYSFAELFPMAIIGVIGGLLGSLFNQLTLYITTWRRNHLHKKGSRVKIIEACLVSILTSAISFGLPLLRKCSPCPDSDLASGIECPRPPGMYGNYVNFFCSKDKEYNDLATIFFNTQDDAIRNLFSAKTINEYSSQSLLTFLVMFYALAVITFGTAVPAGQFVPGIMIGSTYGRLVGMFVVKYYRRLNIEEGTYALLGAASFLGGSMRMTVSLCVIMVEISNNLKFLPLIMLVLLISKAVGDAFNEGIYEEQAQLRGIPLLESRPKYEMRNMTAKEACGSGRVVSFPRVVKVSDVVSILRSNKHNGFPVIDHTRSGEPLVIGLVLRSHLLVILQSKVDFQHSPLPSDPRGGGRSIRHDSGEFAKPVSSKGICIDDIHLSSDDLEMYIDLAPFLNPSPYIVPEDMSLTKVYNLFRQLGLRHLFVVPRPSCVVGLITRKDLLIEDKENVNTLELQSTSVRIPQQNKRLMTRNIDVERPLLNGLLQNQIPD

SEQ ID NO: 19 - DNA, 2298 bp, Glycine max
atgtccacgaactactcaaccaatggagactccgaaactctccttcgtcgtcctttgttgtcctcccaaagatccattgtcaactccacgtcccaggttgctattgtcggctccaatgtcagcccaattgagagcctcgactacgagattttcgagaacgagttcttcaagcatgattggaggagcagagggaaggctcagatatttcagttcatgattatgaagtggctcttgtgccttctaattggcatgatcgtttgccttgttggcttctgcaacaatctcgcggttgagaatctcgctggcatcaagtttgtggtcacgtccaacatgatgttggagagaaggtttctgatggcctttttagtattttttgtttcaaatttggttctcacggtttttgcgtgcacaatcacggctttgatagcacctactgccaccggttcaggtatacccgaggtgaaagcttacctgaatggtgtggatgcacctggaatatttactgtacgaactcttcttgttaagattattggaagtattacagcagtgtcatcatcgcttcttattgggaaggcggggcctatggtgcatacaggtgcatgtgtggctgcattgttaggtcagggtgggtcgaagagatatgggttaacatggaaatggttaaagttttttaagaatgaccgagatcggagagatttaataatatgtggatcagcagctggaattgctgctgccttccgtgcccctgttggtggcgtgttgtttgctcttgaagggatgtcatcttggtggagaagtgcccttttgtggagagctttcttcacagcagcaatagttgcaattttgcttcgtgccctgattgatttatgtttaagtggtaaatgtgggttatttggtaaagggggactgataatgttcgatgcttattcagcaagtatttcatatcatttggtggatgttcctcctgtgtttgttcttggtgttatagggggaatacttggcagcttatttaatttgattttgagtaaagttcttcgcatatacaattttatcaatgagaaaggcaccattttcaaaattttgcttgcctgtttaatctccatttttacatcctgtcttctttttggattgccatggttaacatcttgccgaccttgtccgcctgatccatctgagccttgtcctacaataggtcggtctggtatctacaagaaattccagtgcccacctaatcactacaatgatcttgccagcctcattttcaacacaaatgatgacgctattagaaatctatttagcaagaataccgacgatgagtttgagtttaaatcagtgttcatctttttcatcacttgcttttctttaagtatctttagctatggagttgttgctccagctggtctttttgtgccagttattgtgactggtgcatcttatgggcgtattgttggaatgttgcttggcaaaaaggacagtcttagccatggtctttatgctgtacttggtgctgcttcctttctcggtggctccatgaggacaacagtttctttgtgtgtaattattctagaactgaccaataacctgttattgctacccctaatcatgatggtgctgttcatttctaagactgtagcagatgctttcaatgcaaatatatatgacattataatgaaagccaagggtttgccttatttagaaactcatgctgaaccatatatgaggcagctatcagtaggcgatgtagtcacaggcccacttcagacatttaatggggttgagaaggtttgcaacatagtgtttattctcagaactacgggacataatgggtttcccgttatagacgagcctcctatttcgcaagctccagttttatttggcataatcctccgtgaccatcttctcacattgttgaagaagaaagcttttatgtcctcacctatggcaacaagtggtgatgtcatcaatgagttttcagcagatgattttgcaaagaagggttcaagcaaaggtcgtctaaagatagaggatatacagttatcagaggaagagatggacatgttcatagatctacatccatttactaatgcttctccttatactgttgtggagacaatgtcactgggaaaggcccttacacttttccgagagctaggtttaaggcatctgctagtggtacccaagttctccggtagatcacctgtggtgggtatactcacacgacacgatttcatgtcagaacatatattgggtttgcatccctttctggtaagaaacacagggaaaagtttaagattttaa

SEQ ID NO: 20 - protein, 765 aa, Glycine max
MSTNYSTNGDSETLLRRPLLSSQRSIVNSTSQVAIVGSNVSPIESLDYEIFENEFFKHDWRSRGKAQIFQFMIMKWLLCLLIGMIVCLVGFCNNLAVENLAGIKFVVTSNMMLERRFLMAFLVFFVSNLVLTVFACTITALIAPTATGSGIPEVKAYLNGVDAPGIFTVRTLLVKIIGSITAVSSSLLIGKAGPMVHTGACVAALLGQGGSKRYGLTWKWLKFFKNDRDRRDLIICGSAAGIAAAFRAPVGGVLFALEGMSSWWRSALLWRAFFTAAIVAILLRALIDLCLSGKCGLFGKGGLIMFDAYSASISYHLVDVPPVFVLGVIGGILGSLFNLILSKVLRIYNFINEKGTIFKILLACLISIFTSCLLFGLPWLTSCRPCPPDPSEPCPTIGRSGIYKKFQCPPNHYNDLASLIFNTNDDAIRNLFSKNTDDEFEFKSVFIFFITCFSLSIFSYGVVAPAGLFVPVIVTGASYGRIVGMLLGKKDSLSHGLYAVLGAASFLGGSMRTTVSLCVIILELTNNLLLLPLIMMVLFISKTVADAFNANIYDIIMKAKGLPYLETHAEPYMRQLSVGDVVTGPLQTFNGVEKVCNIVFILRTTGHNGFPVIDEPPISQAPVLFGIILRDHLLTLLKKKAFMSSPMATSGDVINEFSADDFAKKGSSKGRLKIEDIQLSEEEMDMFIDLHPFTNASPYTVVETMSLGKALTLFRELGLRHLLVVPKFSGRSPVVGILTRHDFMSEHILGLHPFLVRNTGKSLRF

SEQ ID NO: 21 - DNA, 2229 bp, Glycine max
atgggagaggattctagggagtttggaaaaagcacaaaaatcaatcacaaaatggaagaagttcaaagagaagaagaaatagacccagaaagcaatcccctgaatgagccactactgctcaagaggactcggacactgtcttccaaccctcttgctctggttggagaaaaagtttcctacatagaaagcttggactatgagataaatgagaatgatctattcaagcatgactggaggagcagatcaagagttcaagtgttacaatacatattcttgaaatggttactagcattccttgttggacttctcactggtattatagccactctcatcaatcttgctgttgagaatattgctgggtataagcttctggctgttcttaaatacatccacaaagaaaggtacttgacgggtttcctatatttcacgggcattaatttcgttttgacatttgttgctgctattctctgtgtgtgttttgcacccacagcagcaggacctggaattcctgagatcaaagcttatcttaatggtgttgatactcccaacatgtttggtgccacaacattgattgtcaagataattggaagcattggagctgtctctgcaggtctagatttgggaaaagaaggaccgttggtgcatataggaagctgcattgcttccttactaggccagggaggccctgacaattacaggaccaaatggcactggcttcgatattttaacaatgatcgtgaccgtcgggatcttatcacctgtggttcatcttcaggagtttgtgcagctttccgggctccagtcggtggagttctctttgctcttgaagaggtggcaacctggtggagaagtgctctcctatggagaacttttttcagcacagctgtggtggtagtggtgctcagggccttcattgaaatctgtcatactgggaaatgcggcctttttggtgaaggaggattgatcatgtttgacgtaagcaatgtcacagtgaggtaccatgttatggatatcgtccttgttgtagtcattggaatcattggtggtgtattgggaagcctttacaatcatgtgctacacaaggtcctcagactctacaatctcatcaatcaaaaaggaagaacacataaactcctcctcagtcttgcagttgcactattcacatcaatgtgccaatatggtctcccattcttagcaaaatgcaccccatgtgatccatcacttccagagtcagcctgccccaccaacggacggtctggaaatttcaaacaattcaactgcccccctggctactacaatgatcttgctactctgctgcttaccactaatgatgatgccgttcgaaacatattctcaaccaacactcctcaagaatatcaaccattgtccctcgtaattttctttctactctattgcatattaggactaattacttttggaattgcagtgccatctgggctcttcctcccaatcattctgatgggctcaggttatggccgccttctcggcatctacatgggacctcatacaaacattgaccaagggctgtttgcagtacttggtgcagcctccctcatggctggttccatgaggatgactgtatccctttgtgtgatcttccttgaactcaccaacaatcttctcctactaccaataacaatgattgttctcctaatagccaaaactgttggagacagtttcaacccaagcatctatgagattatactgcacttgaaaggccttcctttcattgatgcaaatcctgagccatggatgagaaatctcactgtgggtgagcttgttgatgtaaagccaccagtggttaccctccatggagtagaaaaagtagccaaaatagtagatgtcttgaaaaacacaacacataatgctttccctgttatggacaatggggtagtaccaccagtagtaggacaggccaatgggggaacagaacttcatggactgattctaagagcacatctcatccaggcaataaagaagaagtggttccttaaagaaagaaggagaacagaggaatgggaagtgagagagaaatttacctgggtagagctggctgagagagaaggaagtattgaagaggtggctgtgaccagtgaggaaatggaaattgctagagagcatatatcccccagtaattgggatcttgacccaggcaagatctacttgcccaaacattctgacagtctttcctcacctggcaaaatctaa

SEQ ID NO: 22 - protein, 742 aa, Glycine max
MGEDSREFGKSTKINHKMEEVQREEEIDPESNPLNEPLLLKRTRTLSSNPLALVGEKVSYIESLDYEINENDLFKHDWRSRSRVQVLQYIFLKWLLAFLVGLLTGIIATLINLAVENIAGYKLLAVLKYIHKERYLTGFLYFTGINFVLTFVAAILCVCFAPTAAGPGIPEIKAYLNGVDTPNMFGATTLIVKIIGSIGAVSAGLDLGKEGPLVHIGSCIASLLGQGGPDNYRTKWHWLRYFNNDRDRRDLITCGSSSGVCAAFRAPVGGVLFALEEVATWWRSALLWRTFFSTAVVVVVLRAFIEICHTGKCGLFGEGGLIMFDVSNVTVRYHVMDIVLVVVIGIIGGVLGSLYNHVLHKVLRLYNLINQKGRTHKLLLSLAVALFTSMCQYGLPFLAKCTPCDPSLPESACPTNGRSGNFKQFNCPPGYYNDLATLLLTTNDDAVRNIFSTNTPQEYQPLSLVIFFLLYCILGLITFGIAVPSGLFLPIILMGSGYGRLLGIYMGPHTNIDQGLFAVLGAASLMAGSMRMTVSLCVIFLELTNNLLLLPITMIVLLIAKTVGDSFNPSIYEIILHLKGLPFIDANPEPWMRNLTVGELVDVKPPVVTLHGVEKVAKIVDVLKNTTHNAFPVMDNGVVPPVVGQANGGTELHGLILRAHLIQAIKKKWFLKERRRTEEWEVREKFTWVELAEREGSIEEVAVTSEEMEIAREHISPSNWDLDPGKIYLPKHSDSLSSPGKI

SEQ ID NO: 23 - DNA, 2322 bp, Glycine max
atggaaaatgttgaaagagaagaagaaatagacccagaaagcaatccactgaatgagccactgctcaagcggaaccggacactgtcttccaaccctcttgctctggttggagaaaaagtttcctacatagaaagcttggactatgagataaatgagaatgatctattcaagcatgactggaggagcagatcaagagttcaagtgttgcagtatatattcttgaaatggttactagcattccttgttggacttctcactggtattatagccactctcatcaatcttgcagttgagaatattgctgggtataagcttctggctgttcttaaatacatccacaaagaaaggtacttgacgggtttcctatatttcacgggcattaatttcgttttgacgtttgttgctgctattctctgtgtgtgttttgcacccacagcagcaggacctggaattcctgaaatcaaagcttatcttaatggtgttgatactcccaacatgtttggtgctacaacattgattgtcaagataattggaagcattggggctgtctctgcaggcctagatttgggaaaagaaggaccgttggtgcatataggaagctgcattgcttccttactaggccagggaggccctgacaattacaggatcaaatggcgctggcttcgatattttaacaatgatcgtgaccgtcgggatcttatcacctgtggttcatcttcgggagtttgtgcagctttccgggctccagttggtggagttctctttgctcttgaagaggtggcaacctggtggagaagtgctctcctgtggagaacttttttcagcacagctgtggtggtggtggtgctcagggccttcattgaaatctgtcatactgggaaatgcggcctttttggtgaaggaggattgatcatgtttgacgtaagcaatgtcacagtgaggtaccatgttatggatattgtccttgttgtagtcattggaatcattggcggggtattgggaagcctttacaatcatgtactacacaaggtcctcagactctacaatctcatcaatcaaaaaggaagaatacataaactcctcctcagtcttgcagttgcactattcacatcaatgtgcgaatatggtctcccattcttagcaaaatgcaccccatgtgatccatcacttccagagtcaacctgccccaccaatggacggtctgggaatttcaaacaatttaactgcccacctggctactacaatgatcttgctactctgctgcttaccactaatgatgatgccgttcgaaatatattctcaactaacacccctcaagaatatcaacccttgtccctcgtaattttctttgtactctattgcatattaggactaatcacttttggaattgctgtgccatctgggctcttcctcccaatcattcttatgggctcaggttatggccgccttctcggcatctacatgggacctcatacaaacattgaccaagggctgtttgcagtactaggtgcagcctccctcatggctggttccatgaggatgactgtatccctttgtgtgatcttccttgaactcaccaacaatcttctcctactaccaataacaatgattgtcctcctaatagccaaaactgttggagacagtttcaacccaagcatctatgagattatactgcacttgaaaggccttcctttcatggatgcaaatcctgagccatggatgagaaatctcactgtgggtgagcttgttgatgtaaagccatcagtggttaccctccatggagtagaaaaggtagccaaaatagtagatgtcttgaaaaacactacacataatgctttccctgttatggacgatggggtagtaccaccagtagtaggacaggccaatgggggaacagaactgcatggactgattctaagagcacatctcatccaagcactaaagaagaagtggttccttaaagaaagaaggagaacagaggaatgggaagtgagagagaaatttacctgggtagagctggctgagagagaaggaagtattgaagaggtggctgtgaccagtgaggaaatggagatgtttgttgatctacatcctcttaccaatacaactccctttacagtgctagagagcatgtcagtagcaaaagcaatgatcctcttcaggcaagttggacttcgccatctgcttgtagtacccaagtatcaagcatctggggtatccccagtaattgggatcttgaccaggcaagatcttcttgcccataacattctgacagtctttcctcacctggcaatatctaagggtagagaaaagaggaattga

SEQ ID NO: 24 - protein, 773 aa, Glycine max
MENVEREEEIDPESNPLNEPLLKRNRTLSSNPLALVGEKVSYIESLDYEINENDLFKHDWRSRSRVQVLQYIFLKWLLAFLVGLLTGIIATLINLAVENIAGYKLLAVLKYIHKERYLTGFLYFTGINFVLTFVAAILCVCFAPTAAGPGIPEIKAYLNGVDTPNMFGATTLIVKIIGSIGAVSAGLDLGKEGPLVHIGSCIASLLGQGGPDNYRIKWRWLRYFNNDRDRRDLITCGSSSGVCAAFRAPVGGVLFALEEVATWWRSALLWRTFFSTAVVVVVLRAFIEICHTGKCGLFGEGGLIMFDVSNVTVRYHVMDIVLVVVIGIIGGVLGSLYNHVLHKVLRLYNLINQKGRIHKLLLSLAVALFTSMCEYGLPFLAKCTPCDPSLPESTCPTNGRSGNFKQFNCPPGYYNDLATLLLTTNDDAVRNIFSTNTPQEYQPLSLVIFFVLYCILGLITFGIAVPSGLFLPIILMGSGYGRLLGIYMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPSVVTLHGVEKVAKIVDVLKNTTHNAFPVMDDGVVPPVVGQANGGTELHGLILRAHLIQALKKKWFLKERRRTEEWEVREKFTWVELAEREGSIEEVAVTSEEMEMFVDLHPLTNTTPFTVLESMSVAKAMILFRQVGLRHLLVVPKYQASGVSPVIGILTRQDLLAHNILTVFPHLAISKGREKRN

SEQ ID NO: 25 - DNA, 2292 bp, Glycine max
atggaaaatgttgaaagagaagaagaaatagacccagaaagcaatccactgaatgagccactgctcaagcggaaccggacactgtcttccaaccctcttgctctggttggagaaaaagtttcctacatagaaagcttggactatgagataaatgagaatgatctattcaagcatgactggaggagcagatcaagagttcaagtgttgcagtatatattcttgaaatggttactagcattccttgttggacttctcactggtattatagccactctcatcaatcttgcagttgagaatattgctgggtataagcttctggctgttcttaaatacatccacaaagaaaggtacttgacgggtttcctatatttcacgggcattaatttcgttttgacgtttgttgctgctattctctgtgtgtgttttgcacccacagcagcaggacctggaattcctgaaatcaaagcttatcttaatggtgttgatactcccaacatgtttggtgctacaacattgattgtcaagataattggaagcattggggctgtctctgcaggcctagatttgggaaaagaaggaccgttggtgcatataggaagctgcattgcttccttactaggccagggaggccctgacaattacaggatcaaatggcgctggcttcgatattttaacaatgatcgtgaccgtcgggatcttatcacctgtggttcatcttcgggagtttgtgcagctttccgggctccagttggtggagttctctttgctcttgaagaggtggcaacctggtggagaagtgctctcctgtggagaacttttttcagcacagctgtggtggtggtggtgctcagggccttcattgaaatctgtcatactgggaaatgcggcctttttggtgaaggaggattgatcatgtttgacgtaagcaatgtcacagtgaggtaccatgttatggatattgtccttgttgtagtcattggaatcattggcggggtattgggaagcctttacaatcatgtactacacaaggtcctcagactctacaatctcatcaatcatcttgcagttgcactattcacatcaatgtgcgaatatggtctcccattcttagcaaaatgcaccccatgtgatccatcacttccagagtcaacctgccccaccaatggacggtctgggaatttcaaacaatttaactgcccacctggctactacaatgatcttgctactctgctgcttaccactaatgatgatgccgttcgaaatatattctcaactaacacccctcaagaatatcaacccttgtccctcgtaattttctttgtactctattgcatattaggactaatcacttttggaattgctgtgccatctgggctcttcctcccaatcattcttatgggctcaggttatggccgccttctcggcatctacatgggacctcatacaaacattgaccaagggctgtttgcagtactaggtgcagcctccctcatggctggttccatgaggatgactgtatccctttgtgtgatcttccttgaactcaccaacaatcttctcctactaccaataacaatgattgtcctcctaatagccaaaactgttggagacagtttcaacccaagcatctatgagattatactgcacttgaaaggccttcctttcatggatgcaaatcctgagccatggatgagaaatctcactgtgggtgagcttgttgatgtaaagccatcagtggttaccctccatggagtagaaaaggtagccaaaatagtagatgtcttgaaaaacactacacataatgctttccctgttatggacgatggggtagtaccaccagtagtaggacaggccaatgggggaacagaactgcatggactgattctaagagcacatctcatccaagcactaaagaagaagtggttccttaaagaaagaaggagaacagaggaatgggaagtgagagagaaatttacctgggtagagctggctgagagagaaggaagtattgaagaggtggctgtgaccagtgaggaaatggagatgtttgttgatctacatcctcttaccaatacaactccctttacagtgctagagagcatgtcagtagcaaaagcaatgatcctcttcaggcaagttggacttcgccatctgcttgtagtacccaagtatcaagcatctggggtatccccagtaattgggatcttgaccaggcaagatcttcttgcccataacattctgacagtctttcctcacctggcaatatctaagggtagagaaaagaggaattga

SEQ ID NO: 26 - protein, 763 aa, Glycine max
MENVEREEEIDPESNPLNEPLLKRNRTLSSNPLALVGEKVSYIESLDYEINENDLFKHDWRSRSRVQVLQYIFLKWLLAFLVGLLTGIIATLINLAVENIAGYKLLAVLKYIHKERYLTGFLYFTGINFVLTFVAAILCVCFAPTAAGPGIPEIKAYLNGVDTPNMFGATTLIVKIIGSIGAVSAGLDLGKEGPLVHIGSCIASLLGQGGPDNYRIKWRWLRYFNNDRDRRDLITCGSSSGVCAAFRAPVGGVLFALEEVATWWRSALLWRTFFSTAVVVVVLRAFIEICHTGKCGLFGEGGLIMFDVSNVTVRYHVMDIVLVVVIGIIGGVLGSLYNHVLHKVLRLYNLINHLAVALFTSMCEYGLPFLAKCTPCDPSLPESTCPTNGRSGNFKQFNCPPGYYNDLATLLLTTNDDAVRNIFSTNTPQEYQPLSLVIFFVLYCILGLITFGIAVPSGLFLPIILMGSGYGRLLGIYMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPSVVTLHGVEKVAKIVDVLKNTTHNAFPVMDDGVVPPVVGQANGGTELHGLILRAHLIQALKKKWFLKERRRTEEWEVREKFTWVELAEREGSIEEVAVTSEEMEMFVDLHPLTNTTPFTVLESMSVAKAMILFRQVGLRHLLVVPKYQASGVSPVIGILTRQDLLAHNILTVFPHLAISKGREKRN

SEQ ID NO: 27 - DNA, 2352 bp, Glycine max
atgggtgaggaatccagtttgcttaaagaaagcacatcaatcaatgacaccaatatggtggaagaggttgaagaaagggatccagaaagcaatccattgaatgagccacttctcaagaggaacaggactttgtcttccaatccacttgctcttgttggagcaaaagtttcctacatagaaagcttggactacgagatcaatgagaatgacctgttcaaacaagattggaggagcagatcaagaactcaagtgttgcaatacatattctggaaatggactctggcattccttgttggacttctcactggtgtcatagccactcttatcaatcttgctgttgagaacattgccgggtacaagtttcttgctgttgtcaactttatccaaaaagaaaggtacttgagaggtttcctatatttcacgggcattaatttccttttgacatttgttgcttctattctgtgtgtgtgttttgcacccacggcagctgggcctggaatacctgaaatcaaagcttatcttaatggtgttgatactcccaacatgtatggtgccaccacattgtttgttaagataattggaagcattggagctgtatctgcaggcctagatttaggaaaagaagggccattggtacacattggaagctgcattgcttccttactaggccaaggaggccctgacaattacaggatcaagtggcgctggctacggtatttcaacaacgatcgtgaccgtcgcgatcttattacttgtggtgcttcttcaggggtttgtgcagctttcagggcacctgtgggaggagttctctttgctcttgaagaggtggcaacttggtggagaagtgctctcctctggagaacatttttcagcacagctgtggtggtggtagtgctaagggcctctattgaactttgccacaaaggcaagtgtggtctttttggtgaaggagggctcatcatgtatgatgtgagcgatgtcactgttaggtacaatgtgatggatatcatccctgttgttatcattggagtcctaggtggggtattgggaagcctttacaactatcttctccataaggtcctccgtgtctacaatctcatcaatcagaaaggaaaaatgtacaagctcctcctcagtctttcagttgcaatcttcacatcagcgtgccaatatggtctcccattcctagcaaaatgtaccccttgtgatccatccctctcagatgtgtgccccaccaacgggcgttctggaaacttcaaacaattcaactgcccaaaaggctactacaatgatcttgctactcttcttctgaccaccaatgatgatgctgttagaaacatattctcaaccaacacccctcttgaataccaaccctcctccatcataattttctttgcactgtattgcatactaggactaatcacctttgggattgctgtgccatcagggctcttcctccccatcattctcatgggttccggctacggtcgccttctcggcatcctcatggggcctcacacaaacattgatcaagggctgtttgcagtccttggtgcagcctcactcatggctggatccatgagaatgactgtgtccctttgtgtgatcttccttgaactaaccaacaaccttctcctactaccaataaccatgattgttctcctcatagctaaaactgttggagacagcttcaacccaagcatctatgagatcatattgcacctgaaaggcctccctttcatggatgcaaaccctgagccatggatgagaaacctcactgtgggtgagcttgttgatgtgaagccagcagtggttagcttcaaaggagtagaaaaggtggctaacatagtcaatgccttgaaaaacactacacataatggttttcctgtgatggattgtgggctggtgccaaccacaggagtggccaatgaggctacagaactgcacggaatcattctaagagcacaccttatccaagtgctgaagaagaagtggttcttgaaggagagaaggagaactgaggaatgggaagttagagagaaatttacatgggtggagctggctgagagagaagggaatattgaagatgtggctgtgacaaaagaagaaatggagatgtttgttgatttgcatcctctcaccaatactacacccttcacagtgctagagagtatgtcagttgcaaaagcaatggttctcttcagacaagtaggacttcgccatatgcttgttgtgccaaagtatcaagcttcaggggtatctcctgtgattgggatcctgacccggcaagatctactggcatacaacattctgacagtgtttcctcacctggcaaaatcaaagaggaagtga

SEQ ID NO: 28 - protein, 783 aa, Glycine max
MGEESSLLKESTSINDTNMVEEVEERDPESNPLNEPLLKRNRTLSSNPLALVGAKVSYIESLDYEINENDLFKQDWRSRSRTQVLQYIFWKWTLAFLVGLLTGVIATLINLAVENIAGYKFLAVVNFIQKERYLRGFLYFTGINFLLTFVASILCVCFAPTAAGPGIPEIKAYLNGVDTPNMYGATTLFVKIIGSIGAVSAGLDLGKEGPLVHIGSCIASLLGQGGPDNYRIKWRWLRYFNNDRDRRDLITCGASSGVCAAFRAPVGGVLFALEEVATWWRSALLWRTFFSTAVVVVVLRASIELCHKGKCGLFGEGGLIMYDVSDVTVRYNVMDIIPVVIIGVLGGVLGSLYNYLLHKVLRVYNLINQKGKMYKLLLSLSVAIFTSACQYGLPFLAKCTPCDPSLSDVCPTNGRSGNFKQFNCPKGYYNDLATLLLTTNDDAVRNIFSTNTPLEYQPSSIIIFFALYCILGLITFGIAVPSGLFLPIILMGSGYGRLLGILMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPAVVSFKGVEKVANIVNALKNTTHNGFPVMDCGLVPTTGVANEATELHGIILRAHLIQVLKKKWFLKERRRTEEWEVREKFTWVELAEREGNIEDVAVTKEEMEMFVDLHPLTNTTPFTVLESMSVAKAMVLFRQVGLRHMLVVPKYQASGVSPVIGILTRQDLLAYNILTVFPHLAKSKRK

SEQ ID NO: 29 - DNA, 2442 bp, Medicago truncatula
atggtgttggcttgggacattgcagtatgctcctcctcaaggtctcaggttcctatggcatcatcaggtgaagttgctaagaagatggataaagaagaaaacgtaaacaatggcgatgatgtgcatgatatagaaaatgacggtagcttggatgggaatgatgaacaaattggaaggtattggtcacagttttctgaaaggaacatgacgtacgaagaaccacttcttgtgaagaggattaacactacctctcagattgctatagttggttccaacctttgccctattgaaagccttgattatgaggtttttgataatgaaatgtttaaccaggactggaggtccaggaagagggttcagatattccaatatgtggtacttaaatgggtatttgctcttcttattggattaggaactggacttgttggtcttttcaataatatttctgtcgagaacatagctggtttcaagctgactcttacaaccgatctcatgtctaaacaaagattttttgaggcttttctagcatatgctggtctcaatatggttttagcagctgcggctgcagcactctgtgctttcattgctccttcagcagcaggctctggcataccggaggttaaagcatatctcaacggcatcgatgctcattctattctggccccaaccaccctttttgtaaagattgttggttcaatccttggagtatctgctggatttgtggtgggaaaagaaggacctatggttcatacaggagcatgcatagcttctattttggggcaaggcggatctaaaaagtatggtttgacttggagttggcttaggtatttcaaaaacgatcgagaccgacgagacatgattacttgtggtgcagctgctggtgtcgctgccgcctttcgatctccagtaggtggtgtcctctttgcccttgaagaagcagcttcttggtggaggagtgctcttctttggaggtcatttttcactacagcagtagttgctattgttttaagagctggaattcagttttgttcaacaggaaaatgtggactatttggtgaaggtggtcttatattgtatgatgttggttcaccccaaacagaatttagtgccggtgacatagtagcagtaatagtcttgggaactgttgccggtattcttggaagcatatataatttcctcgtcgataaggtcgtccgtacatatagcatcatcaatgaaaaaggtccatttttcaaaatctttcttgctgttgcaatttctcttttgacatcatgctgttattatttcttaccatggattgcaaactgtatcccttgtcctaccgattcaaaggtaccatgtccctctgttgacgaatcaggagaatacaaaatctttcaatgtccaccgggatactacaacgatctcgcttccctctttctaaacaccaacgatgacgctattcgtaatctattcagtcctaagataaccaaagagtttcatatttcaagtttgtttatcttctttgccaccgtttactttcttggaatactcacttatggcattgctgttccatctggacttttcattcctgtgatacttgccggggctgcctacggccgcgttgtgagtagactattcgaaccgatcacgcaactcgacagaggattcttttctctcctaggagctgcctccatgctcggtggcaccatgagaatgacagtctcaatttgtgttatattacttgaactcactaatgatctcttgttacttccacttgtgatgttggtcttattaatctcaaaatctgtggccgatatcttcaacaaaggtgtctatgatcaaatcttgaagatcaaaggacttccttatttggaagcacatgccgaaccttacatgaggaatatagctacacgtgatgttgtctcgggtccattgatgaccttttctggcatcgaaaaggttgggaatatattacatgttttgaatactacagggcacaacgggtttccggtcattgacgaaccgccttttgtggatgcaccagagttgtgtggactagtactgaggtcttatttactagttttactaaaggctaaaaattttactagagagaaggtttacgcgaatccgagtatcttagagaatatttctgtgttggattttggaaaggcgggatcaggaaagggagttaaactagaggacttagatatccaagatgaagatttggatatgtatgttgatcttcatccaataactaatacatcgccgtacactgtagttgagactatgtcacttgctaaagccgctattcttttccgccaacatggactcagacacatgtgtgttgttccaaagagccaagggagacctcctattgtcgggattctaacgcgccatgatttcatgccggagcatgttttgggactttaccctgatatcaagcatcacaaatggcactga

SEQ ID NO: 30 - protein, 813 aa, Medicago truncatula
MVLAWDIAVCSSSRSQVPMASSGEVAKKMDKEENVNNGDDVHDIENDGSLDGNDEQIGRYWSQFSERNMTYEEPLLVKRINTTSQIAIVGSNLCPIESLDYEVFDNEMFNQDWRSRKRVQIFQYVVLKWVFALLIGLGTGLVGLFNNISVENIAGFKLTLTTDLMSKQRFFEAFLAYAGLNMVLAAAAAALCAFIAPSAAGSGIPEVKAYLNGIDAHSILAPTTLFVKIVGSILGVSAGFVVGKEGPMVHTGACIASILGQGGSKKYGLTWSWLRYFKNDRDRRDMITCGAAAGVAAAFRSPVGGVLFALEEAASWWRSALLWRSFFTTAVVAIVLRAGIQFCSTGKCGLFGEGGLILYDVGSPQTEFSAGDIVAVIVLGTVAGILGSIYNFLVDKVVRTYSIINEKGPFFKIFLAVAISLLTSCCYYFLPWIANCIPCPTDSKVPCPSVDESGEYKIFQCPPGYYNDLASLFLNTNDDAIRNLFSPKITKEFHISSLFIFFATVYFLGILTYGIAVPSGLFIPVILAGAAYGRVVSRLFEPITQLDRGFFSLLGAASMLGGTMRMTVSICVILLELTNDLLLLPLVMLVLLISKSVADIFNKGVYDQILKIKGLPYLEAHAEPYMRNIATRDVVSGPLMTFSGIEKVGNILHVLNTTGHNGFPVIDEPPFVDAPELCGLVLRSYLLVLLKAKNFTREKVYANPSILENISVLDFGKAGSGKGVKLEDLDIQDEDLDMYVDLHPITNTSPYTVVETMSLAKAAILFRQHGLRHMCVVPKSQGRPPIVGILTRHDFMPEHVLGLYPDIKHHKWH

SEQ ID NO: 31 - DNA, 2286 bp, Medicago truncatula
atggagtcattaacagaggaaaggattgagataagagatgatcacaaacagccgttactcatcagaagcagaattaataactcttctcaactcgccatcgttggagccaatatttgccctattcagagtcttgattacgagttaattgagaatgatctattgaaacaggactggaggtcaagaacaaaggttgagatataccaatatgttgttctgaagtggacccttgcacttcttattggtttaattacaggacttgttgggttctttaataaccttggagttgagaatattgctggtttcaaacttctactcaccaacaatctcatgctcaagcaaaagtaccatgaggcatttgcagtgtacgttggttgtaacatgattttaggggttggtgcggcagccctgtgtgcttacattgctcctgcagctgctggctctggcataccagaggtgaaggcatacctcaacggcattgatgcacattctatattggccccatctaccctctttgtcaagatatttggttcgattttaggagttgctgctggtttcattgtggggaaagaaggacccatggttcatacaggtgcttgcattgctaatttactcggacaaggtggttcgcgtaaatatcgactcacctggaaatggctcagatacttcaaaaatgatagagataggagggatttgatcacgtgcggtgcagctgctggtgttgccgctgccttccgtgcccccgttggtggtgttctgttcgcactcgaagaggcagcttcatggtggaggagtgctcttctgtggcgcacattctttaccactgcagtagtagcagttgttttgaggagtcttatgcagttctgtcatcagggaggaggcagatgtggtctgtttggagaagggggactcatcatgtttgatgttaattctgcaaagcctgcctacaccacacctgacctcctcgcagttatatttcttggagtcattggaggtctcatgggaagcttttacaattatcttgtcgataaagtccttcgcacttacggcgctataaatgagagaggtccaatattcaagattctgctggtgatgattatctcgtttgtaacctcctgtattcgatttgggcttccattgctatcaaagtgtgtgccatgtccaggggagtgtcccagctccccaaccggaggcttctcaatacactacgacaattttcagtgtccaccaaaccactacaatgatctcagctctctatttttcactaccaacgacgatgccatccgcagcctattcaatgatggctccgcctctgctaacaccggatttcagctatcaagtctcataattttcttcgtggcgatatacttgcttggaattgtgacatacggtgttgccattccctctggactcttcattcccgtcatacttgctggagcttcttacgggcgtcttatagggactgtgatggctccattcacagctcttgatacgggtttgtttgctctccttggagccgcatctttccttggtggcacgatgagaatgacagtttctctatgtgtcatacttcttgaactcactaataacttgttgatgctaccattggtcatgttggttctcctcatttctaagacagtggctgattgttttaacaaaggtgtttatgatcagattgtggcgttgaagggactaccttatatggaagcacatgcagagccatacatgaggaatttagttgcaggggatgttgtttctggtccactgttttctttttgtgggatcgaaaaagtggggaatatattgcacgctttgaaagtgacagaacatcacggatttccagtagttgatgagcctcctttgacggatgctcccgagttgtgtgggttggtgttgaggtctcatctttgggtgcttctcaagcacaagacattgttcactagggagagggtgatgacagggtctactattgtgaacaaggttaaggcaagggattttgcaaaaccaggtttgggaagagggataagggtggaggatttggacatttcacaagaggagatggaaatgtatgttgatcttcatccaatcacaaatacttctccatatactgttgttgaaacaatgtctcttgcaaaagctgctcttctgtttcgggagcttggactcaggcatttgctagttgtgcctaagaaaccaggaaggcctccaattgttgggatactgacaaggcatgatttcatgcacgactatatcttgggcctattcccaaacttgaatccccacaagtag

SEQ ID NO: 32 - protein, 761 aa, Medicago truncatula
MESLTEERIEIRDDHKQPLLIRSRINNSSQLAIVGANICPIQSLDYELIENDLLKQDWRSRTKVEIYQYVVLKWTLALLIGLITGLVGFFNNLGVENIAGFKLLLTNNLMLKQKYHEAFAVYVGCNMILGVGAAALCAYIAPAAAGSGIPEVKAYLNGIDAHSILAPSTLFVKIFGSILGVAAGFIVGKEGPMVHTGACIANLLGQGGSRKYRLTWKWLRYFKNDRDRRDLITCGAAAGVAAAFRAPVGGVLFALEEAASWWRSALLWRTFFTTAVVAVVLRSLMQFCHQGGGRCGLFGEGGLIMFDVNSAKPAYTTPDLLAVIFLGVIGGLMGSFYNYLVDKVLRTYGAINERGPIFKILLVMIISFVTSCIRFGLPLLSKCVPCPGECPSSPTGGFSIHYDNFQCPPNHYNDLSSLFFTTNDDAIRSLFNDGSASANTGFQLSSLIIFFVAIYLLGIVTYGVAIPSGLFIPVILAGASYGRLIGTVMAPFTALDTGLFALLGAASFLGGTMRMTVSLCVILLELTNNLLMLPLVMLVLLISKTVADCFNKGVYDQIVALKGLPYMEAHAEPYMRNLVAGDVVSGPLFSFCGIEKVGNILHALKVTEHHGFPVVDEPPLTDAPELCGLVLRSHLWVLLKHKTLFTRERVMTGSTIVNKVKARDFAKPGLGRGIRVEDLDISQEEMEMYVDLHPITNTSPYTVVETMSLAKAALLFRELGLRHLLVVPKKPGRPPIVGILTRHDFMHDYILGLFPNLNPHK

SEQ ID NO: 33 - DNA, 2331 bp, Medicago truncatula
  misc_feature (2328)..(2328): n is a, c, g, or t
atgtccaataaccatctttctaatggagaatccgaacctcttcttcgccgacccttgttatcttctcaaagatccattatcaactcaacttcacaagttgccatcgttggtgccaatgtctgccctattgagagtctcgattatgagatttttgaaaatgaattcttcaagcaggattggagaagtagaggggttgttcagattttgcagtatatatgtatgaagtggctattatgttttatgattggtttaattgttggttttattgggttttgtaacaatcttgctgttgagaatcttgctggtatcaagtttgtcaccacatccaatatgatgttggaaaggaggtttatgtttgccttttttatattttttgcttcaaatttgagtctcacgctttttgcgtcaataataacggcttttatagcacctactgctgctggttcaggcatatcagaggtgaaggcttacctaaatggtgttgatgcacctggaatttttactgtacgaactctctgtgttaagattattggaagtattacagcagtgtcaggctctcttgttattgggaaggcagggcctatggtgcatacaggtgcatgtgtggcagcattgttgggtcagggaggctccaaaagatatggaataacatggagatggttaagattttttaagaacgaccgtgatcgacgggatctaataatatgcggatcagcagctgggattgctgctgctttccgtgcccctgttggcggcgtcttgtttgctcttgaagagatggcatcttggtggagaactgcccttctatggagagctttttttacaacagcaacagttgcaattttccttcgagctatgattgatgtatgtctaagcgacaaatgcggtttattcggtaaagggggactgataatgtttgatgcttattcagcaagtatttcataccatttggtagatgttcctcctgtgtttattcttgctgttgtaggagggttactcggaagcttatttaattttatgacgaacaaagttcttcgcatatacaatgttatcaacgagaaaggcactatatgcagactttttcttgcttgtttaatctccatttttacatcatgtcttctattcggattgccatggcttgcaccatgccgaccttgccctcctgatgctgttgagccttgtccaacaataggtcgatccggtatctacaagaaattccaatgccctcctaatcactacaatggccttgccagtctcatttttaacacaaatgacgatgctatcagaaacctatttagcatgcacactgacaatgaattcgagctttcgtcaatgttggttttttttatcatatgtctctttttaagtatctttagctgtggaattgttgccccggccggtctgtttgtgccaattatcgtgactggtgcatcgtatgggcgcctggttggaatattggttggagaacggaccaatcttagcaatggcctttatgctgtacttggcgccgcttctcttcttggtggatctatgaggacgacggtttctctgtgtgtaattatgctagaactgaccaataacctgttattgcttcccttaataatgatggtgcttgtggtttccaagagtgtagcaaatgttttcaatgcaaatgtatatgaccttataatgaaagccaaaggtttgccctatttagaaactcacgctgaaccatatatgaggcagttaacagtaggtgatgtagtcacaggcccgcttcagatgtttaatggcatagagaaggttcgcaacatagtgtttatccttagaacaacagcacacaatggattccctgttattgatgagcctccgggttcggaagctccgattttattcggtataattcttcgccaccatcttaccacattgttaaagaagaaagctttcttgccatcacctgtggcgaatagttacgatgtcgtgagaaagttttcatcagatgattttgcgaagaagtattcagttgaacgtgtgaagattgaggatatacagttaacggaggaagagatgggcatgttcgttgatctacatccttttactaatgcttcgccttacactgttgtggaaacaatgtcactggcaaaggcacttatactttttcgagaggtcggtttaagacacttgctcgtgatacccaagatacccggtagatcgcccgtggtgggcatattaacacggcatgattttacaccggaacatatattgggtatgcatccttttctggtaaaaagcaggtggaaaagattaagattttggcaaacttttctagaaaaaattctttctggcatntga

SEQ ID NO: 34 - protein, 776 aa, Medicago truncatula
  misc_feature (776)..(776): Xaa can be any naturally occurring amino acid
MSNNHLSNGESEPLLRRPLLSSQRSIINSTSQVAIVGANVCPIESLDYEIFENEFFKQDWRSRGVVQILQYICMKWLLCFMIGLIVGFIGFCNNLAVENLAGIKFVTTSNMMLERRFMFAFFIFFASNLSLTLFASIITAFIAPTAAGSGISEVKAYLNGVDAPGIFTVRTLCVKIIGSITAVSGSLVIGKAGPMVHTGACVAALLGQGGSKRYGITWRWLRFFKNDRDRRDLIICGSAAGIAAAFRAPVGGVLFALEEMASWWRTALLWRAFFTTATVAIFLRAMIDVCLSDKCGLFGKGGLIMFDAYSASISYHLVDVPPVFILAVVGGLLGSLFNFMTNKVLRIYNVINEKGTICRLFLACLISIFTSCLLFGLPWLAPCRPCPPDAVEPCPTIGRSGIYKKFQCPPNHYNGLASLIFNTNDDAIRNLFSMHTDNEFELSSMLVFFIICLFLSIFSCGIVAPAGLFVPIIVTGASYGRLVGILVGERTNLSNGLYAVLGAASLLGGSMRTTVSLCVIMLELTNNLLLLPLIMMVLVVSKSVANVFNANVYDLIMKAKGLPYLETHAEPYMRQLTVGDVVTGPLQMFNGIEKVRNIVFILRTTAHNGFPVIDEPPGSEAPILFGIILRHHLTTLLKKKAFLPSPVANSYDVVRKFSSDDFAKKYSVERVKIEDIQLTEEEMGMFVDLHPFTNASPYTVVETMSLAKALILFREVGLRHLLVIPKIPGRSPVVGILTRHDFTPEHILGMHPFLVKSRWKRLRFWQTFLEKILSGX

SEQ ID NO: 35 - DNA, 2322 bp, Oryza sativa
atggacggccacccctcgccgcgttcacaccaccagccccctccgccagagcgggacggcagcttcaactacgacgaggccggcggcggcccgcgccagccgctgctgcggaagcgcaccatgaacaccacctctcagatcgccatcgtcggcgccaacgtctgccccatcgagagcctcgactacgaaattgtggaaaatgaccttttcaagcaagactggcgatcgagaaagaagaagcagatatttcagtatattgttcttaaatgggccttagttctgcttattggcatgttgactggaattgttggcttctttaacaatcttgcagtcgaaaatattgcaggattaaaactattgctcacaagtgatctcatgctcaagcagaggtacttcacagcatttttggcatatggtggttgtaatctagtcctggcaactactgctgcagcaatctgtgcttacatagcaccagctgctgctggatctggtattcctgaagttaaagcatatcttaatggggttgatgcttattctatattagctcccagtacactatttgtgaagatatttggttcaatacttggagtttcagctggatttgtacttggaaaggaaggacccatggtacatacaggagcatgcatagccaacttgcttggtcaggggggttcacgcaaataccatcttacatggaattggctgagatattttaagaacgacagggataggcgagatttgattacttgtggatcagcagctggagttgcagcagcatttcgtgcaccagttggtggtgtgctctttgctcttgaggaagcagcatcatggtggcgaagtgctcttctatggagaacattctttacaactgctgttgttgctgttgtgttgaggggccttatcgagttctgtcgtagtggaaaatgcggtctctttgggcaaggagggttgattatgtttgatctaagttcaaccatcccgacatacactgcccaagatgttgtggcaataatagtccttggaataattggcggtgtttttggaggccttttcaattttctcttggataggattctccgtgcctacagtattattaatgagagaggccctccattcaagatccttctcaccatgataatatcaatcatcacctcagcatgctcctatgggctcccatggcttgctccttgcacgccgtgccctgctgatgctgcggaggaatgccccaccattggccggtccggaaactttaagaactttcagtgcccaccgggccattacaacggcctcgcgtcgctcttcttcaacacaaacgatgatgccatccgcaacctgttcagcagtggcaccgagaaggagttccatatgtccaccctgttcgtcttcttcaccgccatctactgccttggcctcgtcacctacggtatcgccgttccatctggtctcttcatccctgtgatacttgctggggctacgtacgggcgcatagttgggacacttctgggtcccatatctgatcttgacccaggcctcttcgcactgctcggtgcggcttctttccttggtgggacaatgaggatgacggtatcagtctgcgtgatccttctggagctcacaaatgacctccacatgctccctttggtcatgctcgtccttctgatatccaagaccatagccgatagcttcaacaagggggtctatgatcagattgtggtgatgaaaggcttgccattcatggaggcacatgccgagccgttcatgaggaacctggttgccggtgacgtcgtgtctgggccactcatcaccttctccggggtcgagaaggtggggaacatcgttcacgcgctgaggatcacgggccacaatgggttcccagtggtcgacgagccacctgtatcagaagccccagagctggttgggttggtgcttcggtcccatctgctggttctgctgaaaggcaggtccttcatgaaggagaaggtgaaaaccagcggtagcttcgtgctgcgaaggtttggtgccttcgacttcgccaagccaggctctgggaaaggcctcaagatcgaagacctggatctcaccgatgaggagctggacatgtatgttgatctccatccgattacaaacacctcaccctacacggtggtcgaaacaatgtcacttgcaaaggctgcagtgctcttcagggcactaggattaaggcacctactggtcgtgccaaagaccccaggaaggccccctatagttggaattctcacaaggcacgatttcatgcatgagcatattcatgggctgttcccaaatctcggcaagtcacactaa

SEQ ID NO: 36 - protein, 773 aa, Oryza sativa
MDGHPSPRSHHQPPPPERDGSFNYDEAGGGPRQPLLRKRTMNTTSQIAIVGANVCPIESLDYEIVENDLFKQDWRSRKKKQIFQYIVLKWALVLLIGMLTGIVGFFNNLAVENIAGLKLLLTSDLMLKQRYFTAFLAYGGCNLVLATTAAAICAYIAPAAAGSGIPEVKAYLNGVDAYSILAPSTLFVKIFGSILGVSAGFVLGKEGPMVHTGACIANLLGQGGSRKYHLTWNWLRYFKNDRDRRDLITCGSAAGVAAAFRAPVGGVLFALEEAASWWRSALLWRTFFTTAVVAVVLRGLIEFCRSGKCGLFGQGGLIMFDLSSTIPTYTAQDVVAIIVLGIIGGVFGGLFNFLLDRILRAYSIINERGPPFKILLTMIISIITSACSYGLPWLAPCTPCPADAAEECPTIGRSGNFKNFQCPPGHYNGLASLFFNTNDDAIRNLFSSGTEKEFHMSTLFVFFTAIYCLGLVTYGIAVPSGLFIPVILAGATYGRIVGTLLGPISDLDPGLFALLGAASFLGGTMRMTVSVCVILLELTNDLHMLPLVMLVLLISKTIADSFNKGVYDQIVVMKGLPFMEAHAEPFMRNLVAGDVVSGPLITFSGVEKVGNIVHALRITGHNGFPVVDEPPVSEAPELVGLVLRSHLLVLLKGRSFMKEKVKTSGSFVLRRFGAFDFAKPGSGKGLKIEDLDLTDEELDMYVDLHPITNTSPYTVVETMSLAKAAVLFRALGLRHLLVVPKTPGRPPIVGILTRHDFMHEHIHGLFPNLGKSH

SEQ ID NO: 37 - DNA, 2382 bp, Oryza sativa
atggctgtaggaacagagagtggctcgggcggcgtagccgagagcgccccctcgacgccaatgtcggcaatgacaacaacgcccatatcggcgaggtcggtgaggtgggagagcgacatgccggacatcgaggagggaggcggcgggctggagcggccgctgctgcgccgccgcggcaccaacaccacgtcgcagatggccatcgtcggcgccaacgtctgccccatcgagagcctcgattacgaacttgtggagaatgaagtgtacaagcaggactggagatcaagggggaaattgcaaatcttccactatcagatccttaaatgggtcctagcacttcttgttggattaatagttggcctaataggattcttcaacaacattgccgtcgaaaacatagccgggttcaagctgctcctgacgaccaatctaatgctccagaacaggtacaaggcggcctttctatggtttatcagctgcaatgcaatgttggcagcagccgctgcagcattgtgcgcttactttggcccagcggctgccggatctggcatacctgaggtgaaggcctatctgaatggtgtcgacgcgccgtccatcttagcgcccagtaccctcttcgtcaagattgttgggtctatatttggggtgtctgctgggtttgtgctgggcaaggaaggtcctatggtgcacactggggcttgtgttgcctcctttctaggacaaggcgggtcgcgcaagtatggcttcacttggaattggctcaggtacttcaagaatgatttggaccgcagggatctgatcacctgtggagctgcagcaggagttacagcagccttccgcgcccctgtcggcggtgtcctcttcgcacttgaagaagcaacatcctggtggcggagcgcgcttctctggaggacattctccacgacagcagtggcggcaatggtgctaaggtccctaatagagtactgccgcagcggcaactgtggcctgttcgggaaaggagggctgatcatgttcgacgtaagttcacaggtgacatcatacaccaccatggatctcgccgcggttgtgctgctcgccatcgtcggcgggctacttggagcactcttcaacttcctcctcaatcggatccttcgtgtgtatagctacatcaacgagaaaggcgcgccgtacaagatcattcttacggtggtcatctcgctggtcacctcgtgctgctccttcggcttgccgtggctgacggcgtgcacgccatgcccgccggagctggccgccagcggccactgcccgaccatcggccgctccggcaacttcaagaacttccggtgtccgccggggcagtacaacgccatggcgtcgctgttcctcaacaccaacgacgacgccatccgcaacctcttcagcggcggcacggagagcgagttcggcgtgcccatgctgctcgcgttcttcaccgccgtctactcgctcggcctggtcacctacggcgtggccgtgccgtcgggcctcttcatccccgtgatcctctccggcgcgtcgttcggccggctgctcgggaagctgctcggcgtgctcaccggcctcgacacggggctcttcgcgctgctcggcgcggcgtccttcctcggcgggacgatgcggatgacggtgtcggtgtgcgtcatcctcctggagctcaccaacgacctcctgctgctgccgctcatcatgctggtgctgctcgtctccaagacggtggccgactgcttcaacaagggcgtgtacgagcagatggtgcgcatgaaggggctcccttacctggaggcgcacgccgagccgtgcatgcgcagcctggtcgccggcgacgtcgtgtccgcgccgctcatcgccttctccagcgtcgagagcgtcggcaccgtcgtggacacgctgcgccgcacggggcacaacgggttcccggtgatcgaggacgcgccgttcgcgccggagccggagctgtgcggcctcgtgctgcgctcccacctcctcgtgctcctccgcgccaagaccttcaccgccgaccgcgtcaagaccggcgccgccgaggtgttccgcaagctcgcgccgttcgacttcgccaagcccgggtcgggcaagggcctcaccgtcgacgacctggacctcaccgaggaggagatggccatgtacgtcgacctccacccgatcgccaaccgctcgccgtacaccgtagtggagaacatgtcgctggccaaggccgccgtgctcttccgccagctcggcctccgccacatgtgcgtcgtgccgaggacgccggggaggccgccggtggtcgggatcctgacgcgacacgacttcatgccgggttacatccgcgggttgtttccgaacgtcctccgtgagtag

SEQ ID NO: 38 - protein, 793 aa, Oryza sativa
MAVGTESGSGGVAESAPSTPMSAMTTTPISARSVRWESDMPDIEEGGGGLERPLLRRRGTNTTSQMAIVGANVCPIESLDYELVENEVYKQDWRSRGKLQIFHYQILKWVLALLVGLIVGLIGFFNNIAVENIAGFKLLLTTNLMLQNRYKAAFLWFISCNAMLAAAAAALCAYFGPAAAGSGIPEVKAYLNGVDAPSILAPSTLFVKIVGSIFGVSAGFVLGKEGPMVHTGACVASFLGQGGSRKYGFTWNWLRYFKNDLDRRDLITCGAAAGVTAAFRAPVGGVLFALEEATSWWRSALLWRTFSTTAVAAMVLRSLIEYCRSGNCGLFGKGGLIMFDVSSQVTSYTTMDLAAVVLLAIVGGLLGALFNFLLNRILRVYSYINEKGAPYKIILTVVISLVTSCCSFGLPWLTACTPCPPELAASGHCPTIGRSGNFKNFRCPPGQYNAMASLFLNTNDDAIRNLFSGGTESEFGVPMLLAFFTAVYSLGLVTYGVAVPSGLFIPVILSGASFGRLLGKLLGVLTGLDTGLFALLGAASFLGGTMRMTVSVCVILLELTNDLLLLPLIMLVLLVSKTVADCFNKGVYEQMVRMKGLPYLEAHAEPCMRSLVAGDVVSAPLIAFSSVESVGTVVDTLRRTGHNGFPVIEDAPFAPEPELCGLVLRSHLLVLLRAKTFTADRVKTGAAEVFRKLAPFDFAKPGSGKGLTVDDLDLTEEEMAMYVDLHPIANRSPYTVVENMSLAKAAVLFRQLGLRHMCVVPRTPGRPPVVGILTRHDFMPGYIRGLFPNVLRE

SEQ ID NO: 39 - DNA, 2415 bp, Oryza sativa
atggaggggcagtcgcagcaccgggcgccggagagggaggggagccacaactacgacatcgagagcacggacgggtccggcgggctgtggcggcggaacggctcgtcgtcgggggcgctgctccgctacaacgacagcggcggcggccgcagcgggagcgccggggagccgctgctgcggaagcgcaccatgaacaccacctcccagatcgccatcgtcggcgccaacgtctgccccatcgagagcctcgactacgaagttgttgagaacgaccttttcaagcaagactggcgatcaagaaagaagaagcagatatttcagtacattgttctgaagtggaccttggtgcttcttattggcctgttgactggacttgttggcttcttcaacaatcttgcagttgaaaacattgctggattcaaactgttgctcacgggtaatcttatgctaaaggaaaggtatttaactgcatttttcgcttatggaggttgcaatttggtcttagcagctgcagcggcagcaatatgtgcttacattgcacctgctgctgctgggtctggtattcccgaagttaaagcatatcttaatggagttgatgcatattcaatattggcccccagtacgctctttgtgaagatatttggttcaatacttggagtttcagctggatttgtacttggaaaggaaggtcctatggtacatacaggggcatgtattgccaacttgcttggtcagggaggatcccgcaagtaccggcttacatgtaattggctaagatattttaagaatgacagggataggcgggatttaattacatgcgggtctgcagctggagtggcagctgccttccgtgctcctgttggtggtgtcctatttgctcttgaggaagcagcatcatggtggcgaagtgctcttttgtggagggcgttctttacaacggctgttgttgctgtcgtgttgagatctcttattgagttctgtcgtagtggaaaatgcggtctctttgggcaaggtggattaattatgttcgatctcagttcaactgttgcaacctacagtactccagatctaatagcaataattatccttggaataattggtggaatctttggaggcctttttaattttctcttggacaaggttctccgtgtttacagtatcataaacgagagaggtgctccattcaagatccttctcactataacaatatcaattatcacatcaatgtgctcttatggtctcccttggcttgctgcgtgcactccatgtcccgtggatgctgtggagcaatgtcctaccattggacgctctggtaacttcaagaactttcaatgtccaccagggcattacaatgatcttgcatcactctttttcaatacaaatgatgatgccatccgcaacctctttagcaatgggactgaatctgagttccacatgtccacccttttcatctttttcactgctgtgtactgccttggaattctgacgtacggtgttgccgtcccatccggtctcttcatccctgttattctcgctggtgcaacatacgggcgcatagtggggacacttcttggatccatatccgaccttgatcctggtctttttgcccttcttggtgcagcatcttttcttggtggaacaatgagaatgaccgtgtcagtctgcgtgatccttctagagctcaccaacgacctggccatgctccctctggtcatgcttgttcttctcatatcgaagactatagcagataactttaataaaggagtttatgatcagatagtggtaatgaaaggcttgccatacatggaggctcatgctgaaccatacatgaggcacttggttgctggcgatgttgtgtctggcccacttattacgttttcaggtgtcgagaaggtgggaaacattgtccatgcgttaaggttcacaggccacaatggattcccagtggttgatgagccacctctaacggaagcacctgaattggtcgggctcgtgacaaggtctcatctgttggttttgctgaatggcaagatgttcatgaaagaccagctgaaaactagtggtagctttgtccttcaaagattcggtgcctttgattttgccaagccagggtcagggaaaggcttgaaaattcaggacctggacttcactgatgaggagatggaaatgtatgtggatctccatcccgttacaaacacctcaccttatacggtggttgagacaatgtcactcgcaaaagctgcaatcctattccgtgcactaggattgaggcaccttttggttgtgccaaagacaccagataggccacccattgtcggaattctcacgaggcatgatttcgtcgaagaacatatccacgggctgttcccaaatctcaatcctcacaagttccactcgacatcgatgggaggctga

SEQ ID NO: 40 - protein, 804 aa, Oryza sativa
MEGQSQHRAPEREGSHNYDIESTDGSGGLWRRNGSSSGALLRYNDSGGGRSGSAGEPLLRKRTMNTTSQIAIVGANVCPIESLDYEVVENDLFKQDWRSRKKKQIFQYIVLKWTLVLLIGLLTGLVGFFNNLAVENIAGFKLLLTGNLMLKERYLTAFFAYGGCNLVLAAAAAAICAYIAPAAAGSGIPEVKAYLNGVDAYSILAPSTLFVKIFGSILGVSAGFVLGKEGPMVHTGACIANLLGQGGSRKYRLTCNWLRYFKNDRDRRDLITCGSAAGVAAAFRAPVGGVLFALEEAASWWRSALLWRAFFTTAVVAVVLRSLIEFCRSGKCGLFGQGGLIMFDLSSTVATYSTPDLIAIIILGIIGGIFGGLFNFLLDKVLRVYSIINERGAPFKILLTITISIITSMCSYGLPWLAACTPCPVDAVEQCPTIGRSGNFKNFQCPPGHYNDLASLFFNTNDDAIRNLFSNGTESEFHMSTLFIFFTAVYCLGILTYGVAVPSGLFIPVILAGATYGRIVGTLLGSISDLDPGLFALLGAASFLGGTMRMTVSVCVILLELTNDLAMLPLVMLVLLISKTIADNFNKGVYDQIVVMKGLPYMEAHAEPYMRHLVAGDVVSGPLITFSGVEKVGNIVHALRFTGHNGFPVVDEPPLTEAPELVGLVTRSHLLVLLNGKMFMKDQLKTSGSFVLQRFGAFDFAKPGSGKGLKIQDLDFTDEEMEMYVDLHPVTNTSPYTVVETMSLAKAAILFRALGLRHLLVVPKTPDRPPIVGILTRHDFVEEHIHGLFPNLNPHKFHSTSMGG

SEQ ID NO: 41 - DNA, 2151 bp, Oryza sativa
atggcgcggctggcgtggacgcggctccccaccgccgacggggcgggggcaggggcggaggggcccgggcccgtccctgcctccccctcgtcggcagggtacgagctcttcgccggcggcgtcgagagcctcgactacgaggtcatcgagaactacgcctaccgggaggagcaggcgcagcggagcaagttctgggtgccgtactacgtcatgctcaagtggctgttctccttgctgatcggcgtcggtactggattggctgctatttttattaatctggcggttgaaaacttctccggctggaaatatgctgcaacatttgctataatacagcactcgtattttgttgggttctttgtgtacatagttttcaatttagccctcgtcttctcatctgtatacatagtaacaaacttcgcaccagcagcagctggatctggtattccggagatcaaaggttacttaaatggagtggatacacatggaatcctccttttcaggacattagttgggaagatctttgggagcattggatcagttggaggaggtttggctctaggaaaagaagggcctcttgttcatactggggcatgcatcgcttctcttctgggacagggtggatcagcaaaataccatttgagttctaggtgggtacggatttttgaaagcgaccgagatcggcgagaccttgtgacatgtggatgtgcagctggggttgctgcagcattcagagctccggttggtggggtactatttgccctggaggaagttacatcctggtggcgaagtcatcttatgtggagagtattctttacatctgctgttgtggctgttgtggtgcgatcagcaatgaactggtgcaagagtggaaagtgtggtcattttggatctgggggtttcataatctgggacatatctggaggccaagaagattactcctaccaagaactattgcctatggcaattattggtgttattggtggacttctaggggcattattcaatcaacttaccctgtatataactaaatggcgtcgaacatatcttcacaaaaaggggaaacgagtgaagatctttgaagcatgccttatatctttggttacatccacaatttcctttgtgttgccattgatgaggaaatgcagttcatgtcctcagttagaaactaattctggcatcgaatgccctcggccacctggaacagatgggaattttgtcaatttttattgttctaaagataacgaatacaacgacctagcaaccattttcttcaatactcaggatgatgcaatacgtaatctattcagtgcaaaaacattccatgaatacagtgcacaaagccttatcaccttcctggtcatgttttactccttagctgtcgtgacatttggaaccgctgttccagctggtcaatttgttccaggaataatgatcggatcaacatatggccggcttgttggaatgtttgttgttaagttttataagaagctaaatgttgaggagggcacgtatgctctacttggtgctgcttcctttcttggtggctcaatgagaatgactgtatctttatgtgttataatggttgaaattactaacaacttgaaactcctgccgttaatcatgcttgtgcttctgatttctaaggccgtgggtgacttttttaatgaagggctgtatgaagtgcaagcccaattaaggggcatccctttacttgactcaagacccaaacaggttatgagaaatatgagtgcgaaggatgcctgcaagaatcaaaaggttgtgtcccttcctcgcgtttcaagaattgttgatattatttctgttttgcgaagcaacaagcataatggcttccctgttgttgatcgtgggcagaatggcgagtcacttgtcataggtctgatacttcgtagtcacttacttgtacttctgcaatctaaagtagatttccagaatagtcctttcccttgtggacctggtatactcaacaggcacaatacaagtgactttgttaaaccagcatcgagtaaaggaaagtcaattgatgatattcatttgacagaagatgagctagggctgtatttggatctcgccccatttctaaatccttctccttatatagtgccagaggacatgtccttagcaaaggtatag

SEQ ID NO: 42 - protein, 716 aa, Oryza sativa
MARLAWTRLPTADGAGAGAEGPGPVPASPSSAGYELFAGGVESLDYEVIENYAYREEQAQRSKFWVPYYVMLKWLFSLLIGVGTGLAAIFINLAVENFSGWKYAATFAIIQHSYFVGFFVYIVFNLALVFSSVYIVTNFAPAAAGSGIPEIKGYLNGVDTHGILLFRTLVGKIFGSIGSVGGGLALGKEGPLVHTGACIASLLGQGGSAKYHLSSRWVRIFESDRDRRDLVTCGCAAGVAAAFRAPVGGVLFALEEVTSWWRSHLMWRVFFTSAVVAVVVRSAMNWCKSGKCGHFGSGGFIIWDISGGQEDYSYQELLPMAIIGVIGGLLGALFNQLTLYITKWRRTYLHKKGKRVKIFEACLISLVTSTISFVLPLMRKCSSCPQLETNSGIECPRPPGTDGNFVNFYCSKDNEYNDLATIFFNTQDDAIRNLFSAKTFHEYSAQSLITFLVMFYSLAVVTFGTAVPAGQFVPGIMIGSTYGRLVGMFVVKFYKKLNVEEGTYALLGAASFLGGSMRMTVSLCVIMVEITNNLKLLPLIMLVLLISKAVGDFFNEGLYEVQAQLRGIPLLDSRPKQVMRNMSAKDACKNQKVVSLPRVSRIVDIISVLRSNKHNGFPVVDRGQNGESLVIGLILRSHLLVLLQSKVDFQNSPFPCGPGILNRHNTSDFVKPASSKGKSIDDIHLTEDELGLYLDLAPFLNPSPYIVPEDMSLAKV

SEQ ID NO: 43 - DNA, 2052 bp, Oryza sativa
atgctctccggcgaccaggacctccccgacggcatcgggatggcgcggctggcgtggacgcggctccccaccgccgacggggcgggggcaggggcggaggggcccgggcccgtccctgcctccccctcgtcggcagggtacgagctcttcgccggcggcgtcgagagcctcgactacgaggtcatcgagaactacgcctaccgggaggagcaggcgcagcggagcaagttctgggtgccgtactacgtcatgctcaagtggctgttctccttgctgatcggcgtcggtactggattggctgctatttttattaatctggcggttgaaaacttctccggctggaaatatgctgcaacatttgctataatacagcactcgtattttgttgggttctttgtgtacatagttttcaatttagccctcgtcttctcatctgtatacatagtaacaaacttcgcaccagcagcagctggatctggtattccggagatcaaaggttacttaaatggagtggatacacatggaatcctccttttcaggacattagttgggaagatctttgggagcattggatcagttggaggaggtttggctctaggaaaagaagggcctcttgttcatactggggcatgcatcgcttctcttctgggacagggtggatcagcaaaataccatttgagttctaggtgggtacggatttttgaaagcgaccgagatcggcgagaccttgtgacatgtggatgtgcagctggggttgctgcagcattcagagctccggttggtggggtactatttgccctggaggaagttacatcctggtggcgaagtcatcttatgtggagagtattctttacatctgctgttgtggctgttgtggtgcgatcagcaatgaactggtgcaagagtggaaagtgtggtcattttggatctgggggtttcataatctgggacatatctggaggccaagaagattactcctaccaagaactattgcctatggcaattattggtgttattggtggacttctaggggcattattcaatcaacttaccctgtatataactaaatggcgtcgaacatatcttcacaaaaaggggaaacgagtgaagatctttgaagcatgccttatatctttggttacatccacaatttcctttgtgttgccattgatgaggaaatgcagttcatgtcctcagttagaaactaattctggcatcgaatgccctcggccacctggaacagatgggaattttgtcaatttttattgttctaaagataacgaatacaacgacctagcaaccattttcttcaatactcaggatgatgcaatacgtaatctattcagtgcaaaaacattccatgaatacagtgcacaaagccttatcaccttcctggtcatgttttactccttagctgtcgtgacatttggaaccgctgttccagctggtcaatttgttccaggaataatgatcggatcaacatatggccggcttgttggaatgtttgttgttaagttttataagaagctaaatgttgaggagggcacgtatgctctacttggtgctgcttcctttcttggtggctcaatgagaatgactgtatctttatgtgttataatggttgaaattactaacaacttgaaactcctgccgttaatcatgcttgtgcttctgatttctaaggccgtgggtgacttttttaatgaagggctgtatgaagtgcaagcccaattaaggggcatccctttacttgactcaagacccaaacaggttatgagaaatatgagtgcgaaggatgcctgcaagaatcaaaaggttgtgtcccttcctcgcgtttcaagaattgttgatattatttctgttttgcgaagcaacaagcataatggcttccctgttgttgatcgtgggcagaatggcgagtcacttgtcataggtctgatacttcgtagtcacttacttgtacttctgcaatctaaagtagatttccagaatagtcctttcccttgtggacctggtatactcaacaggtttgtgcttttctatcataagtag

SEQ ID NO: 44 - protein, 683 aa, Oryza sativa
MLSGDQDLPDGIGMARLAWTRLPTADGAGAGAEGPGPVPASPSSAGYELFAGGVESLDYEVIENYAYREEQAQRSKFWVPYYVMLKWLFSLLIGVGTGLAAIFINLAVENFSGWKYAATFAIIQHSYFVGFFVYIVFNLALVFSSVYIVTNFAPAAAGSGIPEIKGYLNGVDTHGILLFRTLVGKIFGSIGSVGGGLALGKEGPLVHTGACIASLLGQGGSAKYHLSSRWVRIFESDRDRRDLVTCGCAAGVAAAFRAPVGGVLFALEEVTSWWRSHLMWRVFFTSAVVAVVVRSAMNWCKSGKCGHFGSGGFIIWDISGGQEDYSYQELLPMAIIGVIGGLLGALFNQLTLYITKWRRTYLHKKGKRVKIFEACLISLVTSTISFVLPLMRKCSSCPQLETNSGIECPRPPGTDGNFVNFYCSKDNEYNDLATIFFNTQDDAIRNLFSAKTFHEYSAQSLITFLVMFYSLAVVTFGTAVPAGQFVPGIMIGSTYGRLVGMFVVKFYKKLNVEEGTYALLGAASFLGGSMRMTVSLCVIMVEITNNLKLLPLIMLVLLISKAVGDFFNEGLYEVQAQLRGIPLLDSRPKQVMRNMSAKDACKNQKVVSLPRVSRIVDIISVLRSNKHNGFPVVDRGQNGESLVIGLILRSHLLVLLQSKVDFQNSPFPCGPGILNRFVLFYHK

SEQ ID NO: 45 - DNA, 2400 bp, Oryza sativa
atggacggccacccctcgccgcgttcacaccaccagccccctccgccagagcgggacggcagcttcaactacgacatagagagcatggacggcggcggcggcgcgtggcgagggcggtacgagtcgtcggaggtgctgctgcggtacgacgacgaggccggcggcggcccgcgccagccgctgctgcggaagcgcaccatgaacaccacctctcagatcgccatcgtcggcgccaacgtctgccccatcgagagcctcgactacgaaattgtggaaaatgaccttttcaagcaagactggcgatcgagaaagaagaagcagatatttcagtatattgttcttaaatgggccttagttctgcttattggcatgttgactggaattgttggcttctttaacaatcttgcagtcgaaaatattgcaggattaaaactattgctcacaagtgatctcatgctcaagcagaggtacttcacagcatttttggcatatggtggttgtaatctagtcctggcaactactgctgcagcaatctgtgcttacatagcaccagctgctgctggatctggtattcctgaagttaaagcatatcttaatggggttgatgcttattctatattagctcccagtacactatttgtgaagatatttggttcaatacttggagtttcagctggatttgtacttggaaaggaaggacccatggtacatacaggagcatgcatagccaacttgcttggtcaggggggttcacgcaaataccatcttacatggaattggctgagatattttaagaacgacagggataggcgagatttgattacttgtggatcagcagctggagttgcagcagcatttcgtgcaccagttggtggtgtgctctttgctcttgaggaagcggcatcatggtggcgaagtgctcttctatggagaacattctttacaactgctgttgttgctgttgtgttgaggggccttatcgagttctgtcgtagtggaaaatgcggtctctttgggcaaggagggttgattatgtttgatctaagttcaaccatcccgacatacactgcccaagatgttgtggcaataatagtccttggaataattggcggtgtttttggaggccttttcaattttctcttggataggattctccgtgcctacagtattattaatgagagaggccctccattcaagatccttctcaccatgataatatcaatcatcacctcagcatgctcctatgggctcccatggcttgctccttgcacgccgtgccctgctgatgctgcggaggaatgccccaccattggccggtccggaaactttaagaactttcagtgcccaccgggccattacaacggcctcgcgtcgctcttcttcaacacaaacgatgatgccatccgcaacctgttcagcagtggcaccgagaaggagttccatatgtccaccctgttcgtcttcttcaccgccatctactgccttggcctcgtcacctacggtatcgccgttccatctggtctcttcatccctgtgatacttgctggggctacgtacgggcgcatagttgggacacttctgggtcccatatctgatcttgacccaggcctcttcgcactgctcggtgcggcttctttccttggtgggacaatgaggatgacggtatcagtctgcgtgatccttctggagctcacaaatgacctccacatgctccctttggtcatgctcgtccttctgatatccaagaccatagccgatagcttcaacaagggggtctatgatcagattgtggtgatgaaaggcttgccattcatggaggcacatgccgagccgttcatgaggaacctggttgccggtgacgtcgtgtctgggccactcatcaccttctccggggtcgagaaggtggggaacatcgttcacgcgctgaggatcacgggccacaatgggttcccagtggtcgacgagccacctgtatcagaagccccagagctggttgggttggtgcttcggtcccatctgctggttctgctgaaaggcaggtccttcatgaaggagaaggtgaaaaccagcggtagcttcgtgctgcgaaggtttggtgccttcgacttcgccaagccaggctctgggaaaggcctcaagatcgaagacctggatctcaccgatgaggagctggacatgtatgttgatctccatccgattacaaacacctcaccctacacggtggtcgaaacaatgtcacttgcaaaggctgcagtgctcttcagggcactaggattaaggcacctactggtcgtgccaaagaccccaggaaggccccctatagttggaattctcacaaggcacgatttcatgcatgagcatattcatgggctgttcccaaatctcggcaagtcacactaa

SEQ ID NO: 46 - protein, 799 aa, Oryza sativa
MDGHPSPRSHHQPPPPERDGSFNYDIESMDGGGGAWRGRYESSEVLLRYDDEAGGGPRQPLLRKRTMNTTSQIAIVGANVCPIESLDYEIVENDLFKQDWRSRKKKQIFQYIVLKWALVLLIGMLTGIVGFFNNLAVENIAGLKLLLTSDLMLKQRYFTAFLAYGGCNLVLATTAAAICAYIAPAAAGSGIPEVKAYLNGVDAYSILAPSTLFVKIFGSILGVSAGFVLGKEGPMVHTGACIANLLGQGGSRKYHLTWNWLRYFKNDRDRRDLITCGSAAGVAAAFRAPVGGVLFALEEAASWWRSALLWRTFFTTAVVAVVLRGLIEFCRSGKCGLFGQGGLIMFDLSSTIPTYTAQDVVAIIVLGIIGGVFGGLFNFLLDRILRAYSIINERGPPFKILLTMIISIITSACSYGLPWLAPCTPCPADAAEECPTIGRSGNFKNFQCPPGHYNGLASLFFNTNDDAIRNLFSSGTEKEFHMSTLFVFFTAIYCLGLVTYGIAVPSGLFIPVILAGATYGRIVGTLLGPISDLDPGLFALLGAASFLGGTMRMTVSVCVILLELTNDLHMLPLVMLVLLISKTIADSFNKGVYDQIVVMKGLPFMEAHAEPFMRNLVAGDVVSGPLITFSGVEKVGNIVHALRITGHNGFPVVDEPPVSEAPELVGLVLRSHLLVLLKGRSFMKEKVKTSGSFVLRRFGAFDFAKPGSGKGLKIEDLDLTDEELDMYVDLHPITNTSPYTVVETMSLAKAAVLFRALGLRHLLVVPKTPGRPPIVGILTRHDFMHEHIHGLFPNLGKSH

SEQ ID NO: 47 - DNA, 2427 bp, Oryza sativa
atggcgccaagggaccagtcatgtggggacggcggcgaggtggatccggagggtggcatcgaggcgccactcctctcctccggctcctcgttcttccaggacccggcgcacgaggacggcgatggcgacgaggaggcgcgacggcggcggcggaggttcctcctcgccggccgctcccagtccaacaccacctcccaggtggccctcgtcggcgtcggcgtgtgccccatcgagagcctcgactacgagttgatcgagaacgaagtgttcaagcaggactggagggcgcgggggcggggtcacatcctgcgctacgtggcgctcaagtgggccctctgcttcctcgtcggcgtcctctccgccgccgccggattcgtcgccaacctcggcgtcgagaacgtcgccggcgccaagttcgtcgtcacctccaatctcatgctcgccggcagatacgggacagcgtttgcggtgttcctggtttcgaatttcgcccttacgatgttagcaacggtgctgacggtgtatgtggcgccggcggcggccgggtcgggcatccctgaggtgaaggcttacttgaacggggttgatgcccccgacatattttctctaaagaccctggtggtgaagattgtgggttgcattgctgcagtatcatcatcattgcatgtgggaaaagctggtcctctagtacacacaggtgcatgcattgcatctatacttggacaaggtgggtcaagtaaatatcacctgacatgtaaatggctaaggtacttcaagaatgatagggaccgaagggaccttgttacttgtggtgctggtgctggtattgctgctgctttccgggcaccagttggtggagtcctgtttgctcttgaagcagtgtcttcatggtggaggagtgccctactctggcgagcatttttcacaacagcaatggttgctgttgtgcttagggcattgatagacttctgcaaaagtgacaagtgtggcttgtttgggaaaggtggacttataatgtttgatgtgacttcagattacatcacctaccatttggtcgatttaccgccagtaatcactctaggagttcttggtggagtactaggaagcttgcacaactttttcctggacaaggttcttcgtctctacaattttattaacgagaaagggcaaaagtacaagctgctcctggctgcagtagtcaccatttgtacatcctgttgtctcttcggcttgccatggattgcttcttgcaaaccttgtccaagtgacaccgaagaagcctgtccatccataggaagatctggtaattttaagaagtatcagtgtgcaatgaatgagtacaatgacttagctagcctgttcttcaacaccaacgatgacaccattagaaacctttacagtgctggcactgatgatgaattccatatctcttcaatacttgtcttcttcttcacatcgtatttcctgggcattttcagctatggccttgctttaccatccggcctttttgtgccagttattttgacaggtgcaacttatggccgccttgttggcatgttaattgggtcccaatcaacattagatcatggcctttttgcagttcttggctctgctgcccttctaggaggatcaatgagaatgactgtctcagtttgtgtcgtcatcctagagctgactaataatttacttatgcttcctttggttatgctggtccttctcatatcgaagacagtggcagatgcttttaatgcaaatatttatgatttgcttgttaaattgaaaggatttccttatctcgaaggccatgttgaaccttacatgaggcaattgtctgtcagtgatgttgtaactggtcctctacaggcattcaatggcatagagaaggttggccatatagtgcatgtcttaaggacaactggacataatggttttcctgttgttgatgagccaccattttcagattctcctgtcttatttggtctagttcttagagcccacttgcttgttctgctgagaaagaaagatttcattcctaactgctcagcttcagcactggatgcttccaagcaattcttgcctcatgattttgctaaacctggctcaggaaagcatgacagaatagaggaaatagaattcagtgcagaagaactggaaatgttcgtagatttgcatccgttcacaaacacgtctccttacactgtggtcgagactatgtctttggctaaggcccatgtgcttttccgcgaagttggattgaggcatcttttggttctaccaaaatcgtctaagagagcgcctgttgtaggcatactgacaaggcacgacttcatgcctgagcatatattgggtcttcatcctttcctcttcaagactagatggaagaaggtgcggtttggcaagtcagcattcaccaacctcgtcttctga

SEQ ID NO: 48 - protein, 808 aa, Oryza sativa
MAPRDQSCGDGGEVDPEGGIEAPLLSSGSSFFQDPAHEDGDGDEEARRRRRRFLLAGRSQSNTTSQVALVGVGVCPIESLDYELIENEVFKQDWRARGRGHILRYVALKWALCFLVGVLSAAAGFVANLGVENVAGAKFVVTSNLMLAGRYGTAFAVFLVSNFALTMLATVLTVYVAPAAAGSGIPEVKAYLNGVDAPDIFSLKTLVVKIVGCIAAVSSSLHVGKAGPLVHTGACIASILGQGGSSKYHLTCKWLRYFKNDRDRRDLVTCGAGAGIAAAFRAPVGGVLFALEAVSSWWRSALLWRAFFTTAMVAVVLRALIDFCKSDKCGLFGKGGLIMFDVTSDYITYHLVDLPPVITLGVLGGVLGSLHNFFLDKVLRLYNFINEKGQKYKLLLAAVVTICTSCCLFGLPWIASCKPCPSDTEEACPSIGRSGNFKKYQCAMNEYNDLASLFFNTNDDTIRNLYSAGTDDEFHISSILVFFFTSYFLGIFSYGLALPSGLFVPVILTGATYGRLVGMLIGSQSTLDHGLFAVLGSAALLGGSMRMTVSVCVVILELTNNLLMLPLVMLVLLISKTVADAFNANIYDLLVKLKGFPYLEGHVEPYMRQLSVSDVVTGPLQAFNGIEKVGHIVHVLRTTGHNGFPVVDEPPFSDSPVLFGLVLRAHLLVLLRKKDFIPNCSASALDASKQFLPHDFAKPGSGKHDRIEEIEFSAEELEMFVDLHPFTNTSPYTVVETMSLAKAHVLFREVGLRHLLVLPKSSKRAPVVGILTRHDFMPEHILGLHPFLFKTRWKKVRFGKSAFTNLVF

SEQ ID NO: 49 - DNA, 2391 bp, Oryza sativa
atggcgtgcacggctccacgggaggaggacctcctcatggaggaagacgagcaccggccgcctctcaaccgggccctgctccaccgcagcgccaccaacaacacctcccaggttgccatggtcggctccaacccctgccccatagagagcctcgattacgagataatagagaacgacctgttcgatcagaactggaggtcgagagggaaagccgaccaggtgcggtacgtggtgctcaagtggaccttctgcttcgccatcggcatcatcaccggcatcgccggcttcgtcatcaacctcgccgtcgagaatgtcgccggcctcaagcacaccgccgtgtccgccctcatggagtccagcagctattggacagcgttctggctgttcgccggaaccaacctggccctgctgctgttcgcgtcgtccatcacggcgttcgtgtcgccggcggccggcgggtcggggatcccggaggtgaaggcctacctcaacggcgtggacgcgccaaacatcttctcgctcaggacactcgctgtcaagataatcggtaacatcgcggccgtgtcatcctcgctgcacgtcggcaaagctggcccaatggtacacacgggcgcgtgcatcgccgccatcttcggccagggcgggtcgcgcaagtacggcctcacctgccgctggctgcgctacttcaagaacgaccgcgaccgccgtgatctcgtcaccataggcgccggcgcaggtgtcaccgcggctttccgcgcccccgtcggcggcgtcctgttcgctctcgaatcactctcgtcatggtggcggagcgcgctgatctggcggtcgttcttcacgacggcggtggtggcggtggtgctgcggatgttcatcgagctgtgcgcgtcggggaagtgcgggctgttcggcaagggtgggctgatcatgtacgacgtcagcaccaagtttgatgacctcatgacctaccacctcaaggacatccccatcgtcgtcctcatcggcgtgatcggcgccatcttgggcgccctctacaacttcctcatgatgaaggtcctgcgcgtctacagcgtgatcaacgagaggggcaacgcgcacaagctgcttctggcggcggtggtgtccatcctgacgtcgtgctgcgtgttcggcctgccgtggctggcgccgtgccggccgtgcccgacagccggggcgccgtcgccgccgaacgggacgtgccattcgctgaaccgattccggcggttccactgcccggcggggcactacaacgacttggccagcctcttcctcaacatcaacgacgacgccatccgcaacctctactccacgggcaccaacgacgtctaccacccgggctccatgctcgcctttttcgtcgcctcctacgcgctcggcgtgctcagctacggcgtcgtcgcgccgtcggggctgttcgtccccatcatcctcaccggcgccacctacggccgcctcgtcgccatgctgctcggcggccgctcaggactcgaccacggcctcgtcgccatcctcggctccgcctccttcctcggcggcacgctccggatgacggtgtccgtgtgcgtcatcatcctggagctcaccaacaacctgctcctcctcccgctcgtcatgctcgtgctgctcatctccaagaccgtcgccgactccttcaactccagcatctacgacctcatcctcaatctcaagggcctcccgcacctcgacggccacgccgagccgtacatgcggcagctcaccgtcggcgacgtggtggccgggccgctgcggagcttcaacggcgtcgagaaggtgggccacatcgtgcacacgctccggaccacggggcaccacgcgttcccggtggtcgacgagccgcccttctcgccggcaccggtgctgtacggcctcgtgctgcgcgcgcacctgctggtactgctcaagaagcgggagttcctgacggcgccggtgcggtgccccaaggactacatggccgggaggttcgaggcgcaggacttcgacaagcgcgggtccgggaagcaggacaccatcgccgacgtggagctgtcgccggaggagatggagatgtacgtcgacctgcaccccttcaccaacacgtcgccgtacacggtggtggagaccatgtcgctggccaaggcgctcgtcctcttccgcgaggtcggcctgcgacacctcctcgtcgtgcccaagtcctgcgacaggtcgccggtggtggggatcctgacgaggcacgacttcatgccggagcacatcctcgggctgcacccggtgctggtgggaagccggtggaagcggctccggtggcagaagggcgccgtcgccaagaaattccggtcgctcctcgactggctagccaacgacagcggctga

SEQ ID NO: 50 - protein, 796 aa, Oryza sativa
MACTAPREEDLLMEEDEHRPPLNRALLHRSATNNTSQVAMVGSNPCPIESLDYEIIENDLFDQNWRSRGKADQVRYVVLKWTFCFAIGIITGIAGFVINLAVENVAGLKHTAVSALMESSSYWTAFWLFAGTNLALLLFASSITAFVSPAAGGSGIPEVKAYLNGVDAPNIFSLRTLAVKIIGNIAAVSSSLHVGKAGPMVHTGACIAAIFGQGGSRKYGLTCRWLRYFKNDRDRRDLVTIGAGAGVTAAFRAPVGGVLFALESLSSWWRSALIWRSFFTTAVVAVVLRMFIELCASGKCGLFGKGGLIMYDVSTKFDDLMTYHLKDIPIVVLIGVIGAILGALYNFLMMKVLRVYSVINERGNAHKLLLAAVVSILTSCCVFGLPWLAPCRPCPTAGAPSPPNGTCHSLNRFRRFHCPAGHYNDLASLFLNINDDAIRNLYSTGTNDVYHPGSMLAFFVASYALGVLSYGVVAPSGLFVPIILTGATYGRLVAMLLGGRSGLDHGLVAILGSASFLGGTLRMTVSVCVIILELTNNLLLLPLVMLVLLISKTVADSFNSSIYDLILNLKGLPHLDGHAEPYMRQLTVGDVVAGPLRSFNGVEKVGHIVHTLRTTGHHAFPVVDEPPFSPAPVLYGLVLRAHLLVLLKKREFLTAPVRCPKDYMAGRFEAQDFDKRGSGKQDTIADVELSPEEMEMYVDLHPFTNTSPYTVVETMSLAKALVLFREVGLRHLLVVPKSCDRSPVVGILTRHDFMPEHILGLHPVLVGSRWKRLRWQKGAVAKKFRSLLDWLANDSG

SEQ ID NO: 51 - DNA, 2283 bp, Oryza sativa
atggcgtgcacggctccacgggaggaggacctcctcatggaggaagacgagcaccggccgcctctcaaccgggccctgctccaccgcagcgccaccaacaacacctcccaggtgcggtacgtggtgctcaagtggaccttctgcttcgccatcggcatcatcaccggcatcgccggcttcgtcatcaacctcgccgtcgagaatgtcgccggcctcaagcacaccgccgtgtccgccctcatggagtccagcagctattggacagcgttctggctgttcgccggaaccaacctggccctgctgctgttcgcgtcgtccatcacggcgttcgtgtcgccggcggccggcgggtcggggatcccggaggtgaaggcctacctcaacggcgtggacgcgccaaacatcttctcgctcaggacactcgctgtcaagataatcggtaacatcgcggccgtgtcatcctcgctgcacgtcggcaaagctggcccaatggtacacacgggcgcgtgcatcgccgccatcttcggccagggcgggtcgcgcaagtacggcctcacctgccgctggctgcgctacttcaagaacgaccgcgaccgccgtgatctcgtcaccataggcgccggcgcaggtgtcaccgcggctttccgcgcccccgtcggcggcgtcctgttcgctctcgaatcactctcgtcatggtggcggagcgcgctgatctggcggtcgttcttcacgacggcggtggtggcggtggtgctgcggatgttcatcgagctgtgcgcgtcggggaagtgcgggctgttcggcaagggtgggctgatcatgtacgacgtcagcaccaagtttgatgacctcatgacctaccacctcaaggacatccccatcgtcgtcctcatcggcgtgatcggcgccatcttgggcgccctctacaacttcctcatgatgaaggtcctgcgcgtctacagcgtgatcaacgagaggggcaacgcgcacaagctgcttctggcggcggtggtgtccatcctgacgtcgtgctgcgtgttcggcctgccgtggctggcgccgtgccggccgtgcccgacagccggggcgccgtcgccgccgaacgggacgtgccattcgctgaaccgattccggcggttccactgcccggcggggcactacaacgacttggccagcctcttcctcaacatcaacgacgacgccatccgcaacctctactccacgggcaccaacgacgtctaccacccgggctccatgctcgcctttttcgtcgcctcctacgcgctcggcgtgctcagctacggcgtcgtcgcgccgtcggggctgttcgtccccatcatcctcaccggcgccacctacggccgcctcgtcgccatgctgctcggcggccgctcaggactcgaccacggcctcgtcgccatcctcggctccgcctccttcctcggcggcacgctccggatgacggtgtccgtgtgcgtcatcatcctggagctcaccaacaacctgctcctcctcccgctcgtcatgctcgtgctgctcatctccaagaccgtcgccgactccttcaactccagcatctacgacctcatcctcaatctcaagggcctcccgcacctcgacggccacgccgagccgtacatgcggcagctcaccgtcggcgacgtggtggccgggccgctgcggagcttcaacggcgtcgagaaggtgggccacatcgtgcacacgctccggaccacggggcaccacgcgttcccggtggtcgacgagccgcccttctcgccggcaccggtgctgtacggcctcgtgctgcgcgcgcacctgctggtactgctcaagaagcgggagttcctgacggcgccggtgcggtgccccaaggactacatggccgggaggttcgaggcgcaggacttcgacaagcgcgggtccgggaagcaggacaccatcgccgacgtggagctgtcgccggaggagatggagatgtacgtcgacctgcaccccttcaccaacacgtcgccgtacacggtggtggagaccatgtcgctggccaaggcgctcgtcctcttccgcgaggtcggcctgcgacacctcctcgtcgtgcccaagtcctgcgacaggtcgccggtggtggggatcctgacgaggcacgacttcatgccggagcacatcctcgggctgcacccggtgctggtgggaagccggtggaagcggctccggtggcagaagggcgccgtcgccaagaaattccggtcgctcctcgactggctagccaacgacagcggctga

SEQ ID NO: 52 - protein, 760 aa, Oryza sativa
MACTAPREEDLLMEEDEHRPPLNRALLHRSATNNTSQVRYVVLKWTFCFAIGIITGIAGFVINLAVENVAGLKHTAVSALMESSSYWTAFWLFAGTNLALLLFASSITAFVSPAAGGSGIPEVKAYLNGVDAPNIFSLRTLAVKIIGNIAAVSSSLHVGKAGPMVHTGACIAAIFGQGGSRKYGLTCRWLRYFKNDRDRRDLVTIGAGAGVTAAFRAPVGGVLFALESLSSWWRSALIWRSFFTTAVVAVVLRMFIELCASGKCGLFGKGGLIMYDVSTKFDDLMTYHLKDIPIVVLIGVIGAILGALYNFLMMKVLRVYSVINERGNAHKLLLAAVVSILTSCCVFGLPWLAPCRPCPTAGAPSPPNGTCHSLNRFRRFHCPAGHYNDLASLFLNINDDAIRNLYSTGTNDVYHPGSMLAFFVASYALGVLSYGVVAPSGLFVPIILTGATYGRLVAMLLGGRSGLDHGLVAILGSASFLGGTLRMTVSVCVIILELTNNLLLLPLVMLVLLISKTVADSFNSSIYDLILNLKGLPHLDGHAEPYMRQLTVGDVVAGPLRSFNGVEKVGHIVHTLRTTGHHAFPVVDEPPFSPAPVLYGLVLRAHLLVLLKKREFLTAPVRCPKDYMAGRFEAQDFDKRGSGKQDTIADVELSPEEMEMYVDLHPFTNTSPYTVVETMSLAKALVLFREVGLRHLLVVPKSCDRSPVVGILTRHDFMPEHILGLHPVLVGSRWKRLRWQKGAVAKKFRSLLDWLANDSG

SEQ ID NO: 53 - DNA, 2409 bp, Oryza sativa
atggcgccaagggaccagtcatgtggggacggcggcgaggtggatccggagggtggcatcgaggcgccactcctctcctccggctcctcgttcttccaggacccggcgcacgaggacggcgatggcgacgaggaggcgcgacggcggcggcggaggttcctcctcgccggccgctcccagtccaacaccacctcccaggtggccctcgtcggcgtcggcgtgtgccccatcgagagcctcgactacgagttgatcgagaacgaagtgttcaagcaggactggagggcgcgggggcggggtcacatcctgcgctacgtggcgctcaagtgggccctctgcttcctcgtcggcgtcctctccgccgccgccggattcgtcgccaacctcggcgtcgagaacgtcgccggcgccaagttcgtcgtcacctccaatctcatgctcgccggcagatacgggacagcgtttgcggtgttcctggtttcgaatttcgcccttacgatgttagcaacggtgctgacggtgtatgtggcgccggcggcggccgggtcgggcatccctgaggtgaaggcttacttgaacggggttgatgcccccgacatattttctctaaagaccctggtggtgaagattgtgggttgcattgctgcagtatcatcatcattgcatgtgggaaaagctggtcctctagtacacacaggtgcatgcattgcatctatacttggacaaggtgggtcaagtaaatatcacctgacatgtaaatggctaaggtacttcaagaatgatagggaccgaagggaccttgttacttgtggtgctggtgctggtattgctgctgctttccgggcaccagttggcggagtcctgtttgctcttgaagcagtgtcttcatggtggaggagtgccctactctggcgagcatttttcacaacagcaatggttgctgttgtgcttagggcattgatagacttctgcaaaagtgacaagtgtggcttgtttgggaaaggtggacttataatgtttgatgtgacttcagattacatcacctaccatttggtcgatttaccgccagtaatcactctaggagttcttggtggagtactaggaagcttgcacaactttttcctggacaagcttactttcaggaaagggcaaaagtacaagctgctcctggctgcagtagtcaccatttgtacatcctgttgtctcttcggcttgccatggattgcttcttgcaaaccttgtccaagtgacaccgaagaagcctgtccatccataggaagatctggtaattttaagaagtatcagtgtgcaatgaatgagtacaatgacttagctagcctgttcttcaacaccaacgatgacaccattagaaacctttacagtgctggcactgatgatgaattccatatctcttcaatacttgtcttcttcttcacatcgtatttcctgggcattttcagctatggccttgctttaccatccggcctttttgtgccagttattttgacaggtgcaacttatggccgccttgttggcatgttaattgggtcccaatcaacattagatcatggcctttttgcagttcttggctctgctgcccttctaggaggatcaatgagaatgactgtctcagtttgtgtcgtcatcctagagctgactaataatttacttatgcttcctttggttatgctggtccttctcatatcgaagacagtggcagatgcttttaatgcaaatatttatgatttgcttgttaaattgaaaggatttccttatctcgaaggccatgttgaaccttacatgaggcaattgtctgtcagtgatgttgtaactggtcctctacaggcattcaatggcatagagaaggttggccatatagtgcatgtcttaaggacaactggacataatggttttcctgttgttgatgagccaccattttcagattctcctgtcttatttggtctagttcttagagcccacttgcttgttctgctgagaaagaaagatttcattcctaactgctcagcttcagcactggatgcttccaagcaattcttgcctcatgattttgctaaacctggctcaggaaagcatgacagaatagaggaaatagaattcagtgcagaagaactggaaatgttcgtagatttgcatccgttcacaaacacgtctccttacactgtggtcgagactatgtctttggctaaggcccatgtgcttttccgcgaagttggattgaggcatcttttggttctaccaaaatcgtctaagagagcgcctgttgtaggcatactgacaaggcacgacttcatgcctgagcatatattgggtcttcatcctttcctcttcaagactagatggaagaaggtgcggtttggcaagtcagcattcaccaacctcgtcttctga

SEQ ID NO: 54 - protein, 802 aa, Oryza sativa
MAPRDQSCGDGGEVDPEGGIEAPLLSSGSSFFQDPAHEDGDGDEEARRRRRRFLLAGRSQSNTTSQVALVGVGVCPIESLDYELIENEVFKQDWRARGRGHILRYVALKWALCFLVGVLSAAAGFVANLGVENVAGAKFVVTSNLMLAGRYGTAFAVFLVSNFALTMLATVLTVYVAPAAAGSGIPEVKAYLNGVDAPDIFSLKTLVVKIVGCIAAVSSSLHVGKAGPLVHTGACIASILGQGGSSKYHLTCKWLRYFKNDRDRRDLVTCGAGAGIAAAFRAPVGGVLFALEAVSSWWRSALLWRAFFTTAMVAVVLRALIDFCKSDKCGLFGKGGLIMFDVTSDYITYHLVDLPPVITLGVLGGVLGSLHNFFLDKLTFRKGQKYKLLLAAVVTICTSCCLFGLPWIASCKPCPSDTEEACPSIGRSGNFKKYQCAMNEYNDLASLFFNTNDDTIRNLYSAGTDDEFHISSILVFFFTSYFLGIFSYGLALPSGLFVPVILTGATYGRLVGMLIGSQSTLDHGLFAVLGSAALLGGSMRMTVSVCVVILELTNNLLMLPLVMLVLLISKTVADAFNANIYDLLVKLKGFPYLEGHVEPYMRQLSVSDVVTGPLQAFNGIEKVGHIVHVLRTTGHNGFPVVDEPPFSDSPVLFGLVLRAHLLVLLRKKDFIPNCSASALDASKQFLPHDFAKPGSGKHDRIEEIEFSAEELEMFVDLHPFTNTSPYTVVETMSLAKAHVLFREVGLRHLLVLPKSSKRAPVVGILTRHDFMPEHILGLHPFLFKTRWKKVRFGKSAFTNLVF

SEQ ID NO: 55 - DNA, 2415 bp, Oryza sativa
atgctctccggcgaccaggacctccccgacggcatcgggatggcgcggctggcgtggacgcggctccccaccgccgacggggcgggggcaggggcggaggggcccgggcccgtccctgcctccccctcgtcggcagggtacgagctcttcgccggcggcgtagagagcctcgactacgaggtcatcgagaactacgcctaccgggaggagcaggcgcagcggagcaagttctgggtgccgtactacgtcatgctcaagtggctgttctccttgctgatcggcgtcggtactggattggatgctatttttattaatctggcggttgaaaacttctccggctggaaatatgctgcaacatttgctataatacagcactcgtattttgttgggttctttgtgtacatagttttcaatttagccctcgtcttctcatctgtatacatagtaacaaacttcgcaccagcagcagctggatctggtattccggagatcaaaggttacttaaatggagtggatacacatggaatcctccttttcaggacattagttgggaagatctttgggagcattggatcagttggaggaggtttggctctaggaaaagaagggcctcttgttcatactggggcatgcatcgcttctcttctgggacagggtggatcagcaaaataccatttgagttctaggtgggtacggatttttgaaagcgaccgagatcggcgagaccttgtgacatgtggatgtgcagctggggttgctgcagcattcagagctccggttggtggggtactatttgccctggaggaagttacatcctggtggcgaagtcatcttatgtggagagtattctttacatctgctgttgtggctgttgtggtgcgatcagcaatgaactggtgcaagagtggaaagtgtggtcattttggatctgggggtttcataatctgggacatatctggaggccaagaagattactcctaccaagaactattgcctatggcaattattggtgttattggtggacttctaggggcattattcaatcaacttaccctgtatataactaaatggcgtcgaacatatcttcacaaaaaggggaaacgagtgaagatctttgaagcatgccttatatctttggttacatccacaatttcctttgtgttgccattgatgaggaaatgcagttcatgtcctcagttagaaactaattctggcatcgaatgccctcggccacctggaacagatgggaattttgtcaatttttattgttctaaagataacgaatacaacgacctagcaaccattttcttcaatactcaggatgatgcaatacgtaatctattcagtgcaaaaacattccatgaatacagtgcacaaagccttatcaccttcctggtcatgttttactccttagctgtcgtgacatttggaaccgctgttccagctggtcaatttgttccaggaataatgatcggatcaacatatggccggcttgttggaatgtttgttgttaagttttataagaagctaaatgttgaggagggcacgtatgctctacttggtgctgcttcctttcttggtggctcaatgagaatgactgtatctttatgtgttataatggttgaaattactaacaacttgaaactcctgccgttaatcatgcttgtgcttctgatttctaaggccgtgggtgacttttttaatgaagggctgtatgaagtgcaagcccaattaaggggcatccctttacttgactcaagacccaaacaggttatgagaaatatgagtgcgaaggatgcctgcaagaatcaaaaggttgtgtcccttcctcgcgtttcaagaattgttgatattatttctgttttgcgaagcaacaagcataatggcttccctgttgttgatcgtgggcagaatggcgagtcacttgtcataggtctgatacttcgtagtcacttacttgtacttctgcaatctaaagtagatttccagaatagtcctttcccttgtggacctggtatactcaacaggcacaatacaagtgactttgttaaaccagcatcgagtaaaggaaagtcaattgatgatattcatttgacagaagatgagctagggctgtatttggatctcgccccatttctaaatccttctccttatatagtgccagaggacatgtccttagcaaaggtgtacaatctcttccgccaactaggattgcgacatatatttgttgttccacggccttctcgtgttgttggattaataacaagacaagatcttttacttgaggagaacggcaataatgtgacaactgagctccagtcgactagtgtaaggggtcagctgaatggcaaaatgctcagtggcagcacacatctggggcatcctcttcttgatagtattgtggttgaggagtaa

SEQ ID NO: 56 - protein, 804 aa, Oryza sativa
MLSGDQDLPDGIGMARLAWTRLPTADGAGAGAEGPGPVPASPSSAGYELFAGGVESLDYEVIENYAYREEQAQRSKFWVPYYVMLKWLFSLLIGVGTGLDAIFINLAVENFSGWKYAATFAIIQHSYFVGFFVYIVFNLALVFSSVYIVTNFAPAAAGSGIPEIKGYLNGVDTHGILLFRTLVGKIFGSIGSVGGGLALGKEGPLVHTGACIASLLGQGGSAKYHLSSRWVRIFESDRDRRDLVTCGCAAGVAAAFRAPVGGVLFALEEVTSWWRSHLMWRVFFTSAVVAVVVRSAMNWCKSGKCGHFGSGGFIIWDISGGQEDYSYQELLPMAIIGVIGGLLGALFNQLTLYITKWRRTYLHKKGKRVKIFEACLISLVTSTISFVLPLMRKCSSCPQLETNSGIECPRPPGTDGNFVNFYCSKDNEYNDLATIFFNTQDDAIRNLFSAKTFHEYSAQSLITFLVMFYSLAVVTFGTAVPAGQFVPGIMIGSTYGRLVGMFVVKFYKKLNVEEGTYALLGAASFLGGSMRMTVSLCVIMVEITNNLKLLPLIMLVLLISKAVGDFFNEGLYEVQAQLRGIPLLDSRPKQVMRNMSAKDACKNQKVVSLPRVSRIVDIISVLRSNKHNGFPVVDRGQNGESLVIGLILRSHLLVLLQSKVDFQNSPFPCGPGILNRHNTSDFVKPASSKGKSIDDIHLTEDELGLYLDLAPFLNPSPYIVPEDMSLAKVYNLFRQLGLRHIFVVPRPSRVVGLITRQDLLLEENGNNVTTELQSTSVRGQLNGKMLSGSTHLGHPLLDSIVVEE

SEQ ID NO: 57 - DNA, 2427 bp, Oryza sativa
atggcgccaagggaccagtcatgtggggacggcggcgaggtggatccggagggtggcatcgaggcgccactcctctcctccggctcctcgttcttccaggacccggcgcacgaggacggcgatggcgacgaggaggcgcgacggcggcggcggaggttcctcctcgccggccgctcccagtccaacaccacctcccaggtggccctcgtcggcgtcggcgtgtgccccatcgagagcctcgactacgagttgatcgagaacgaagtgttcaagcaggactggagggcgcgggggcggggtcacatcctgcgctacgtggcgctcaagtgggccctctgcttcctcgtcggcgtcctctccgccgccgccggattcgtcgccaacctcggcgtcgagaacgtcgccggcgccaagttcgtcgtcacctccaatctcatgctcgccggcagatacgggacagcgtttgcggtgttcctggtttcgaatttcgcccttacgatgttagcaacggtgctgacggtgtatgtggcgccggcggcggccgggtcgggcatccctgaggtgaaggcttacttgaacggggttgatgcccccgacatattttctctaaagaccctggtggtgaagattgtgggttgcattgctgcagtatcatcatcattgcatgtgggaaaagctggtcctctagtacacacaggtgcatgcattgcatctatacttggacaaggtgggtcaagtaaatatcacctgacatgtaaatggctaaggtacttcaagaatgatagggaccgaagggaccttgttacttgtggtgctggtgctggtattgctgctgctttccgggcaccagttggtggagtcctgtttgctcttgaagcagtgtcttcatggtggaggagtgccctactctggcgagcatttttcacaacagcaatggttgctgttgtgcttagggcattgatagacttctgcaaaagtgacaagtgtggcttgtttgggaaaggtggacttataatgtttgatgtgacttcagattacatcacctaccatttggtcgatttaccgccagtaatcactctaggagttcttggtggagtactaggaagcttgcacaactttttcctggacaaggttcttcgtctctacaattttattaacgagaaagggcaaaagtacaagctgctcctggctgcagtagtcaccatttgtacatcctgttgtctcttcggcttgccatggattgcttcttgcaaaccttgtccaagtgacaccgaagaagcctgtccatccataggaagatctggtaattttaagaagtatcagtgtgcaatgaatgagtacaatgacttagctagcctgttcttcaacaccaacgatgacaccattagaaacctttacagtgctggcactgatgatgaattccatatctcttcaatacttgtcttcttcttcacatcgtatttcctgggcattttcagctatggccttgctttaccatccggcctttttgtgccagttattttgacaggtgcaacttatggccgccttgttggcatgttaattgggtcccaatcaacattagatcatggcctttttgcagttcttggctctgctgcccttctaggaggatcaatgagaatgactgtctcagtttgtgtcgtcatcctagagctgactaataatttacttatgcttcctttggttatgctggtccttctcatatcgaagacagtggcagatgcttttaatgcaaatatttatgatttgcttgttaaattgaaaggatttccttatctcgaaggccatgttgaaccttacatgaggcaattgtctgtcagtgatgttgtaactggtcctctacaggcattcaatggcatagagaaggttggccatatagtgcatgtcttaaggacaactggacataatggttttcctgttgttgatgagccaccattttcagattctcctgtcttatttggtctagttcttagagcccacttgcttgttctgctgagaaagaaaaatttcattcctaactgctcagcttcagcactggatgcttccaagcaattcttgcctcatgattttgctaaacctggctcaggaaagcatgacagaatagaggaaatagaattcagtgcagaagaactggaaatgttcgtagatttgcatccgttcacaaacacgtctccttacactgtggtcgagactatgtctttggctaaggcccatgtgcttttccgcgaagttggattgaggcatcttttggttctaccaaaatcgtctaagagagcgcctgttgtaggcatactgacaaggcacgacttcatgcctgagcatatattgggtcttcatcctttcctcttcaagactagatggaagaaggtgcggtttggcaagtcaacattcaccaacctcgtcttctga

SEQ ID NO: 58 - protein, 808 aa, Oryza sativa
MAPRDQSCGDGGEVDPEGGIEAPLLSSGSSFFQDPAHEDGDGDEEARRRRRRFLLAGRSQSNTTSQVALVGVGVCPIESLDYELIENEVFKQDWRARGRGHILRYVALKWALCFLVGVLSAAAGFVANLGVENVAGAKFVVTSNLMLAGRYGTAFAVFLVSNFALTMLATVLTVYVAPAAAGSGIPEVKAYLNGVDAPDIFSLKTLVVKIVGCIAAVSSSLHVGKAGPLVHTGACIASILGQGGSSKYHLTCKWLRYFKNDRDRRDLVTCGAGAGIAAAFRAPVGGVLFALEAVSSWWRSALLWRAFFTTAMVAVVLRALIDFCKSDKCGLFGKGGLIMFDVTSDYITYHLVDLPPVITLGVLGGVLGSLHNFFLDKVLRLYNFINEKGQKYKLLLAAVVTICTSCCLFGLPWIASCKPCPSDTEEACPSIGRSGNFKKYQCAMNEYNDLASLFFNTNDDTIRNLYSAGTDDEFHISSILVFFFTSYFLGIFSYGLALPSGLFVPVILTGATYGRLVGMLIGSQSTLDHGLFAVLGSAALLGGSMRMTVSVCVVILELTNNLLMLPLVMLVLLISKTVADAFNANIYDLLVKLKGFPYLEGHVEPYMRQLSVSDVVTGPLQAFNGIEKVGHIVHVLRTTGHNGFPVVDEPPFSDSPVLFGLVLRAHLLVLLRKKNFIPNCSASALDASKQFLPHDFAKPGSGKHDRIEEIEFSAEELEMFVDLHPFTNTSPYTVVETMSLAKAHVLFREVGLRHLLVLPKSSKRAPVVGILTRHDFMPEHILGLHPFLFKTRWKKVRFGKSTFTNLVF

SEQ ID NO: 59 - DNA, 2322 bp, Oryza sativa
atgtcggcaatgacaacaacgcccatatcggcgaggtcggtgaggtgggagagcgacatgccggacatcgaggagggaggcggcgggctggagcggccgctgctgcgccgccgcggcaccaacaccacgtcgcagatggccatcgtcggcgccaacgtctgccccatcgagagcctcgattacgaacttgtggagaatgaagtgtacaagcaggactggagatcaagggggaaattgcaaatcttccactatcagatccttaaatgggtcctagcacttcttgttggattaatagttggcctaataggattcttcaacaacattgccgtcgaaaacatagccgggttcaagctgctcctgacgaccaatctaatgctccagaacaggtacaaggcggcctttctatggtttatcagctgcaatgcaatgttggcagcagccgctgcagcattgtgcgcttactttggcccagcggctgccggatctggcatacctgaggtgaaggcctatctgaatggtgtcgacgcgccgtccatcttagcgcccagtaccctcttcgtcaagattgttgggtctatatttggggtgtctgctgggtttgtgctgggcaaggaaggtcctatggtgcacactggggcttgtgttgcctcctttctaggacaaggcgggtcgcgcaagtatggcttcacttggaattggctcaggtacttcaagaatgatttggaccgcagggatctgatcacctgtggagctgcagcaggagttacagcagccttccgcgcccctgtcggcggtgtcctcttcgcacttgaagaagcaacatcctggtggcggagcgcgcttctctggaggacattctccacgacagcagtggcggcaatggtgctaaggtccctaatagagtactgccgcagcggcaactgtggcctgttcgggaaaggagggctgatcatgttcgacgtaagttcacaggtgacatcatacaccaccatggatctcgccgcggttgtgctgctcgccatcgtcggcgggctacttggagcactcttcaacttcctcctcaatcggatccttcgtgtgtatagctacatcaacgagaaaggcgcgccgtacaagatcattcttacggtggtcatctcgctggtcacctcgtgctgctccttcggcttgccgtggctgacggcgtgcacgccatgcccgccggagctggccgccagcggccactgcccgaccatcggccgctccggcaacttcaagaacttccggtgtccgccggggcagtacaacgccatggcgtcgctgttcctcaacaccaacgacgacgccatccgcaacctcttcagcggcggcacggagagcgagttcggcgtgcccatgctgctcgcgttcttcaccgccgtctactcgctcggcctggtcacctacggcgtggccgtgccgtcgggcctcttcatccccgtgatcctctccggcgcgtcgttcggccggctgctcgggaagctgctcggcgtgctcaccggcctcgacacggggctcttcgcgctgctcggcgcggcgtccttcctcggcgggacgatgcggatgacggtgtcggtgtgcgtcatcctcctggagctcaccaacgacctcctgctgctgccgctcatcatgctggtgctgctcgtctccaagacggtggccgactgcttcaacaagggcgtgtacgagcagatggtgcgcatgaaggggctcccttacctggaggcgcacgccgagccgtgcatgcgcagcctggtcgccggcgacgtcgtgtccgcgccgctcatcgccttctccagcgtcgagagcgtcggcaccgtcgtggacacgctgcgccgcacggggcacaacgggttcccggtgatcgaggacgcgccgttcgcgccggagccggagctgtgcggcctcgtgctgcgctcccacctcctcgtgctcctccgcgccaagaccttcaccgccgaccgcgtcaagaccggcgccgccgaggtgttccgcaagctcgcgccgttcgacttcgccaagcccgggtcgggcaagggcctcaccgtcgacgacctggacctcaccgaggaggagatggccatgtacgtcgacctccacccgatcgccaaccgctcgccgtacaccgtagtggagaacatgtcgctggccaaggccgccgtgctcttccgccagctcggcctccgccacatgtgcgtcgtgccgaggacgccggggaggccgccggtggtcgggatcctgacgcgacacgacttcatgccgggttacatccgcgggttgtttccgaacgtcctccgtgagtag

SEQ ID NO: 60 - protein, 773 aa, Oryza sativa
MSAMTTTPISARSVRWESDMPDIEEGGGGLERPLLRRRGTNTTSQMAIVGANVCPIESLDYELVENEVYKQDWRSRGKLQIFHYQILKWVLALLVGLIVGLIGFFNNIAVENIAGFKLLLTTNLMLQNRYKAAFLWFISCNAMLAAAAAALCAYFGPAAAGSGIPEVKAYLNGVDAPSILAPSTLFVKIVGSIFGVSAGFVLGKEGPMVHTGACVASFLGQGGSRKYGFTWNWLRYFKNDLDRRDLITCGAAAGVTAAFRAPVGGVLFALEEATSWWRSALLWRTFSTTAVAAMVLRSLIEYCRSGNCGLFGKGGLIMFDVSSQVTSYTTMDLAAVVLLAIVGGLLGALFNFLLNRILRVYSYINEKGAPYKIILTVVISLVTSCCSFGLPWLTACTPCPPELAASGHCPTIGRSGNFKNFRCPPGQYNAMASLFLNTNDDAIRNLFSGGTESEFGVPMLLAFFTAVYSLGLVTYGVAVPSGLFIPVILSGASFGRLLGKLLGVLTGLDTGLFALLGAASFLGGTMRMTVSVCVILLELTNDLLLLPLIMLVLLVSKTVADCFNKGVYEQMVRMKGLPYLEAHAEPCMRSLVAGDVVSAPLIAFSSVESVGTVVDTLRRTGHNGFPVIEDAPFAPEPELCGLVLRSHLLVLLRAKTFTADRVKTGAAEVFRKLAPFDFAKPGSGKGLTVDDLDLTEEEMAMYVDLHPIANRSPYTVVENMSLAKAAVLFRQLGLRHMCVVPRTPGRPPVVGILTRHDFMPGYIRGLFPNVLRE

SEQ ID NO: 61 - DNA, 2406 bp, Oryza sativa
atggacggccacccctcgccgcgttcacaccaccagccccctccgccagagcgggacggcagcttcaactacgacatagagagcatggacggcggcggcggcgcgtggcgagggcggtacgagtcgtcggaggtgctgctgcggtacgacgacgaggccggcggcggcccgcgccagccgctgctgcggaagcgcaccatgaacaccacctctcagatcgccatcgtcggcgccaacgtctgccccatcgagagcctcgactacgaaattgtggaaaatgaccttttcaagcaagactggcgatcgagaaagaagaagcagatatttcagtatattgttcttaaatgggccttagttctgcttattggcatgttgactggaattgttggcttctttaacaatcttgcagtcgaaaatattgcaggattaaaactattgctcacaagtgatctcatgctcaagcagaagtgcaggtacttcacagcatttttggcatatggtggttgtaatctagtcctggcaactactgctgcagcaatctgtgcttacatagcaccagctgctgctggatctggtattcctgaagttaaagcatatcttaatggggttgatgcttattctatattacctcccaatacactatttgtgaagatatttggttcaatacttggagtttcagctggatttgtacttggaaaggaaggacccatggtacatacaggagcatgcatagccaacttgcttggtcaggggggttcacgcaaataccatcttacatggaattggctgagatattttaagaacgacagggataggcgagatttgattacttgtggatcagcagctggagttgcagcagcatttcgtgcaccagttggtggtgtgctctttgctcttgaggaagcagcatcatggtggcgaagtgctcttctatggagaacattctttacaactgctgttgttgctgttgtgttgaggggccttatcgagttctgtcgtagtggaaaatgcggtctctttgggcaaggagggttgattatgtttgatctaagttcaaccatcccgacatacactgcccaagatgttgtggcaataatagtccttggaataattggcggtgtttttggaggccttttcaattttctcttggataggattctccgtgcctacagtattattaatgagagaggccctccattcaagatccttctcaccatgataatatcaatcatcacctcagcatgctcctatgggctcccatggcttgctccttgcacgccgtgccctgctgatgctgcggaggaatgccccaccattggccggtccggaaactttaagaactttcagtgcccaccgggccattacaacggcctcgcgtcgctcttcttcaacacaaacgatgatgccatccgcaacctgttcagcagtggcaccgagaaagagttccatatgtccaccctgttcgtcttcttcaccgccatctactgccttggcctcgtcacctacggtatcgccgttccatctggtctcttcatccctgtgatacttgctggggctacgtacgggcgcatagttgggacacttctgggtcccatatctgatcttgacccaggcctcttcgcactgctcggtgcggcttctttccttggtgggacaatgaggatgacggtatcagtctgcgtgatccttctggagctcacaaatgacctccacatgctccctttggtcatgctcgtccttctgatatccaagaccatagccgatagcttcaacaagggggtctatgatcagattgtggtgatgaaaggcttgccattcatggaggcacatgccgagccgttcatgaggaacctggttgccggtgacgtcgtgtctgggccactcatcaccttctccggggtcgagaaggtggggaacatcgttcacgcgctgaggatcacgggccacaatgggttcccagtggtcgacgagccacctgtatcagaagccccagagctggttgggttggtgcttcggtcccatctgctggttctgctgaaaggcaggtccttcatgaaggagaaggtgaaaaccagcggtagcttcgtgctgcgaaggtttggtgccttcgacttcgccaagccaggctctgggaaaggcctcaagatcgaagacctggatctcaccgatgaggagctggacatgtatgttgatctccatccgattacaaacacctcaccctacacggtggtcgaaacaatgtcacttgcaaaggctgcagtgctcttcagggcactaggattaaggcacctactggtcgtgccaaagaccccaggaaggccccctatagttggaattctcacaaggcacgatttcatgcatgagcatattcatgggctgttcccaaatctcggcaagtcacactaa

SEQ ID NO: 62 - protein, 801 aa, Oryza sativa
MDGHPSPRSHHQPPPPERDGSFNYDIESMDGGGGAWRGRYESSEVLLRYDDEAGGGPRQPLLRKRTMNTTSQIAIVGANVCPIESLDYEIVENDLFKQDWRSRKKKQIFQYIVLKWALVLLIGMLTGIVGFFNNLAVENIAGLKLLLTSDLMLKQKCRYFTAFLAYGGCNLVLATTAAAICAYIAPAAAGSGIPEVKAYLNGVDAYSILPPNTLFVKIFGSILGVSAGFVLGKEGPMVHTGACIANLLGQGGSRKYHLTWNWLRYFKNDRDRRDLITCGSAAGVAAAFRAPVGGVLFALEEAASWWRSALLWRTFFTTAVVAVVLRGLIEFCRSGKCGLFGQGGLIMFDLSSTIPTYTAQDVVAIIVLGIIGGVFGGLFNFLLDRILRAYSIINERGPPFKILLTMIISIITSACSYGLPWLAPCTPCPADAAEECPTIGRSGNFKNFQCPPGHYNGLASLFFNTNDDAIRNLFSSGTEKEFHMSTLFVFFTAIYCLGLVTYGIAVPSGLFIPVILAGATYGRIVGTLLGPISDLDPGLFALLGAASFLGGTMRMTVSVCVILLELTNDLHMLPLVMLVLLISKTIADSFNKGVYDQIVVMKGLPFMEAHAEPFMRNLVAGDVVSGPLITFSGVEKVGNIVHALRITGHNGFPVVDEPPVSEAPELVGLVLRSHLLVLLKGRSFMKEKVKTSGSFVLRRFGAFDFAKPGSGKGLKIEDLDLTDEELDMYVDLHPITNTSPYTVVETMSLAKAAVLFRALGLRHLLVVPKTPGRPPIVGILTRHDFMHEHIHGLFPNLGKSH

SEQ ID NO: 63 - DNA, 2406 bp, Physcomitrella patens
atgggtgggaatgatgaaatgggaaatgtggaggaggagagcctgccgcctccgcaccttgatctgtacgagccgctcctggagaaggagaaggttgctacagctggtaacgcaaatgggaacgtcatcaatggtacccatcacacggcgatgatcggcacaagggttgcacctattgagagtcttgattatgaactcgttgagaacgagctattcagacaagactggcgttccaggaaaaaacgagagatcttacagtatgtcgcggtgaagtggacatttgtgtttcttgtcggcattttaactgctattgctgccttggggatcaacactgccgtggagaacattgctggagtgaaatttctgcttacagttaaattcatggagtcaaacaggtttgtatgggcgtttttggtctacgccggtttcaatgtgatgttggtcatgagtgctgcgctcctatgtgtgtacataggcccttcagcagcaggttcaggtattccagaagtcaaggcttatcttaatggagtcgatacgcccaacatattctcaattaagactcttgttgtcaaggcaacattgattcttggaagcataggatccgtagctggtggtttaattgtgggaaaagaaggtccacttgtgcatgtgggctcctgcattgcttcattacttggtcagggagggtctgtgaaatatggtttgacctgtaaatggttacgatacctgaaaaacgatcgtgatcggcgagatttggtgacttgtggagcagctgctggagttgcagcggcttttcgtgcacctgtaggaggggtgttatttgcactagaagaagttacctcttggtggcgaggtcctctattatggagggcatttttcaccacggcagtagttgctgtagtgatacgcaccggaattgcttggtgtaagcaaggacactgtggcatggctggtgaaggtggcttgatcatttttgacgtaagtggagtgcaagaaagctatgggctgagagaactttcctcagtggctgtttcgggagtgctagggggtgtgcttggcagcctcttcaaccagattaatgctaagattatcgtttggagtggcacgtggcttaagaagaagggaaagttcgctaaaattatccaggcgatccttattgctctcgtcacctcaatttgcagttttggacttccatttcttgctaaatgtcaaccttgtccagaccatcttactattcctggagaaaaggcgtgtcctacctacggccgtgctggcaacttcaagaatttccactgccccgatggtagttacaacgatttggcaggccttttctttaacacaaatgaggatagtgtgagaaatttgttcagcaaggggactaatggagagtttcagttcagctccctttttgtatatctgacatccgcatattcacttgcgcttctcacatatggtactgcggtaccgtctgggctgtttgtcccggctattctgtgtggggctacatatggcagaattgtcggcatgattatgggatcattttacgtaaatggtcatatggatgagggggtttacgctctcctaggagcagcatcattccttggaggctccatgcggatgactgtctccctttgcattatattgctggagctgacaaataatttgctgttgcttcctctgatcatgctcgtgttgttgatatcgaagaccgtgggagatgctttcaacgatggtctttactctctgcatgtgcatatcaaggggattcctttccttgaagctcatcctcctcaatttatgagccatctgactgcacgcgatgctattactcgaccgttgatttggttttcgaaagttgaacgtgttggaacaattgctgaggttttgcgtagcacaaatcatcacgcttttcctgtagtggatgacgacgttgaatgtagtgggaaaccagtattttttggccttgttctgaggtctcatttattggtcttgctgaagaagaaggagtttgctaaaaataggctctctcgatctgaagtgcaaagcagtcgcgttacggcagctgaatttgccaaacctggctctggcaaggggctaaccatttcagatattgagttgaccgtagtggaagaggagatgttccttgatttgacgggtattgccaatacttctccgtatacagttgttcacaccatgtctttagcgaaggcttacacattgtttcgacagctcggactccgccatctttgtgtcatgccaagggcttctgagggtcaacctataattggattattgacacgacatgattttatgtcagcatatcttctgaacctctatcctcacttacgacagaacaattacacaaagattcaagcttttacctccaaaagagatgaacagctgtag

SEQ ID NO: 64 - protein, 801 aa, Physcomitrella patens
MGGNDEMGNVEEESLPPPHLDLYEPLLEKEKVATAGNANGNVINGTHHTAMIGTRVAPIESLDYELVENELFRQDWRSRKKREILQYVAVKWTFVFLVGILTAIAALGINTAVENIAGVKFLLTVKFMESNRFVWAFLVYAGFNVMLVMSAALLCVYIGPSAAGSGIPEVKAYLNGVDTPNIFSIKTLVVKATLILGSIGSVAGGLIVGKEGPLVHVGSCIASLLGQGGSVKYGLTCKWLRYLKNDRDRRDLVTCGAAAGVAAAFRAPVGGVLFALEEVTSWWRGPLLWRAFFTTAVVAVVIRTGIAWCKQGHCGMAGEGGLIIFDVSGVQESYGLRELSSVAVSGVLGGVLGSLFNQINAKIIVWSGTWLKKKGKFAKIIQAILIALVTSICSFGLPFLAKCQPCPDHLTIPGEKACPTYGRAGNFKNFHCPDGSYNDLAGLFFNTNEDSVRNLFSKGTNGEFQFSSLFVYLTSAYSLALLTYGTAVPSGLFVPAILCGATYGRIVGMIMGSFYVNGHMDEGVYALLGAASFLGGSMRMTVSLCIILLELTNNLLLLPLIMLVLLISKTVGDAFNDGLYSLHVHIKGIPFLEAHPPQFMSHLTARDAITRPLIWFSKVERVGTIAEVLRSTNHHAFPVVDDDVECSGKPVFFGLVLRSHLLVLLKKKEFAKNRLSRSEVQSSRVTAAEFAKPGSGKGLTISDIELTVVEEEMFLDLTGIANTSPYTVVHTMSLAKAYTLFRQLGLRHLCVMPRASEGQPIIGLLTRHDFMSAYLLNLYPHLRQNNYTKIQAFTSKRDEQL

SEQ ID NO: 65 - DNA, 2175 bp, Physcomitrella patens
atgttgggatatcgggacccgggtatggagagtcttgattatgaggtcgtggaaagcgtcgcttatcgagaggatcaggcacaacgaggaatttggcatcatgcttcctacataaccctgaaatggaccttttctctgctcattggtatagggacagggcttgccgcctttcttatcaatattgcagtagaaaatttctcgggatggaagtttgcggcaacatttgctcttatgaaatatagcacctttttaggtttagtaatctacattgcatttaatgcagctttagtattttcatctgtttacatcatcactcaatttgctcccgctgcagcagggtcaggcattccagagatcaaggcttatttaaatggtgttgatactcctggtattctcttgtttcggacgttgattggaaaggtgctaggtagtattggttctgttggaggagggttggctttgggcaaggaggggcctctagttcacacgggtgcctgtattgcatcagtacttgggcaggcaatgcagggcggctcaacaaagtaccatgtgaattggagatggcttcggaggtttaagaatgatcgtgatcgtcgtgatcttgtaacatgtgggtgtgctgctggagtagcggcagctttcagagcccctgttgggggtgtcttgtttgctcttgaggaggtcacttcttggtggaggagtcagcttttatggcgggtttttttcacatcagctgtggttgccgttgtggtgaggactgcgatgggttggtgcaagcatggaaattgtggacattttggttcaggtggatttatcatatgggatatttcagggggtcaggacgattattcattttttgagcttttacctatggccatgcttggtgcaattggaggacttctgggggcacttttcaaccagcttactatctggatctcaacctggagaaggaatgtgttgcacagaagaggcactcgtgttaagattattgaggttctcctggtatcattgataacatcgatgttatcatttggtttgccaatgatgactacctgtaaaccgtgccctgatccagtgaagtacccaagtgttatctgtccccgcccctcgggcaactacggcaattatgtcaatttcttttgtccaaacgagaaccagtacaacgaccttgccacaatcttttttaatacgcaggatgatgcaatcagaaaccttttcagcaccaacaccccacatgaatactccactcgtagcctcttgaccttcctggtgatgtttttcgtgctagcagtgctgacatacggaacagctgttccatcagggcagtttgttccaggtattatgattggtgccacttacgggcgacttgtcggcattttggttgtcaatgcttcgagtaaggatagtgttgacgaaggaacgtatgctttgctgggggctgcctcatttctgggcggctcaatgcggatgaccgtgtcactctgtgttatcatggtcgagattactaataatcttcaactacttccactcattatgttggtcctccttatttctaaggctgttggagatgctttcaatagtgggttttatgaggaacaggtcaagcttcgaagtcttcctcttcttgagtcaaggccgcaacgtttcatgcggaatttggctgccaaagatgcttctggtacaagaaagattgtgcagttctcaagggtgtcgaaagttggccatattgtagccgtcttacgaagcaccaatcataatggcttcccagttgttgataagcttcagacaggagagcctgtcgtcattggtcttattttaaggagctatttactggttcttcttcaagccaaaacggattttcagcgtactcctactctaggagatactcgcgatagaagaaatttcagatatgatgtgagagattttacaaagccagtatcgagcaaaggtatctccatttacgacattgatatcagcgcccaagagatggagatgtacatcgacttgcaaccatttgtgaatcccacaccttacattgttcctgaggacatgtctctcacaaaagtgtataatttatttcggcagcttgggttgcggcatatatgcgttgtgccacgaccttcacaagttgtgggagtaatcacacggaaggatttattaccagaggcgagttaa

SEQ ID NO: 66 - protein, 724 aa, Physcomitrella patens
MLGYRDPGMESLDYEVVESVAYREDQAQRGIWHHASYITLKWTFSLLIGIGTGLAAFLINIAVENFSGWKFAATFALMKYSTFLGLVIYIAFNAALVFSSVYIITQFAPAAAGSGIPEIKAYLNGVDTPGILLFRTLIGKVLGSIGSVGGGLALGKEGPLVHTGACIASVLGQAMQGGSTKYHVNWRWLRRFKNDRDRRDLVTCGCAAGVAAAFRAPVGGVLFALEEVTSWWRSQLLWRVFFTSAVVAVVVRTAMGWCKHGNCGHFGSGGFIIWDISGGQDDYSFFELLPMAMLGAIGGLLGALFNQLTIWISTWRRNVLHRRGTRVKIIEVLLVSLITSMLSFGLPMMTTCKPCPDPVKYPSVICPRPSGNYGNYVNFFCPNENQYNDLATIFFNTQDDAIRNLFSTNTPHEYSTRSLLTFLVMFFVLAVLTYGTAVPSGQFVPGIMIGATYGRLVGILVVNASSKDSVDEGTYALLGAASFLGGSMRMTVSLCVIMVEITNNLQLLPLIMLVLLISKAVGDAFNSGFYEEQVKLRSLPLLESRPQRFMRNLAAKDASGTRKIVQFSRVSKVGHIVAVLRSTNHNGFPVVDKLQTGEPVVIGLILRSYLLVLLQAKTDFQRTPTLGDTRDRRNFRYDVRDFTKPVSSKGISIYDIDISAQEMEMYIDLQPFVNPTPYIVPEDMSLTKVYNLFRQLGLRHICVVPRPSQVVGVITRKDLLPEAS

SEQ ID NO: 67 - DNA, 2232 bp, Populus trichocarpa
atgttgagagagccatttcttgttaggaatagaaagaacaatacttcacagattgccattgttggtgctaatacctgccccatcgaaagccttgattatgagattgctgagaatgaacttttgaaacaggactggagatctcgaaagaaggctgagatatttcagtatgttgtcctcaagtggacacttgctctcctcattgggttaggtacagggcttgtcggctttttcaataaccttgccattgagaatatagctggtttcaaacttctggtgacaaacaatctcatgcttaaggagatgtactatcaggcatttgcaacttatgctggttgcaatgtggttttggctattgctgctgcagccttatgtgcttatgttgctcctgcggcagcaggatctggtataccagaggttaaagcatacctcaatggtgtagatgctccttctattttggcacctgctaccctttttgtaaagatatttgggtccatatttggggttgctgctggatttgttgttggcaaagaaggacccatggtgcatactggtgcttgcatagcctcctttcttggacagggaggttctcgtaagtatcatttgacatggaaatggctgagatacttcaaaaatgatcgagaccggcgagatttgatcacatgtggttctgctgctggtgtagcagctgccttccgtgctcctgttggcggggtcttatttgcccttgaagaagctgcttcctggtggaggagtgcccttctttggaggacattcttcacaacagctgtagtagcagttgtattgagaagtctcatagaattttgccgaactggaaaatgtgggctgtttggacaaggaggtctgatcatgtttgatgtaaattcgacaaaagctacttatagtaccccagatctagtagcagttatgttccttggagtgataggaggtgtttttggaagcttttacaactattgtgttgacaaggtccttcgcacttacagcatcatcaatgagagaggtccttcgtttaagatcctgcttgttattgtcatttccctgctgacctcttgttgctcctacggcctcccatggctttcacagtgcattccctgtccccctcacctggctgagcaatgccccactgaaagtcgctctggaaacttcaagaatttccagtgtccaccaaaccactataacaatcttgcttccctctttttcaacaccaatgatgatgccatccgcatcttattcacttctggcagcgaaaaagaatttgacctctccacccttctggttttcttcgttgctattttctgccttggcattgttacttatggcattgctgttccctctgggctcttcatcccagtcattcttgctggggcctcttatggccgtcttgttggaacactgctcggtcccctttctaatcttgatgtgggtctctttgcccttcttggagctgcctccttccttggtggcaccatgagaatgacagtttctctttgtgtcatacttctcgaactgactaatgatctgcttatgcttccattaatgatgctagtgctcctcatttcaaaatctgtggctgatattttcaataagggtgtttatgatcaaattatgaaaattaaaggattgccttatatggaaacccatgcagaaccatacatgagacaccttattgcaagtgatgttgtttctggtccattagtttcattctctggggttgaaaaggtagggaacatattacatgtcctgagagtaacaaggcataatggatttcctgtgattgacgagccgccttattcagatgctccagaattatgtgggcttgtcttgaggtctcatctgctcgtgttgcttaaaggaaagaaatttacaaagcagagagtaaagacaggatcagatattgtgaggggtttcaaggcacatgactttgcaaaggctggatcgggcaaaggggtgaagctggaagatttggagatcacagaggaggagatggagatgtatattgatctccatcctattgctaacacatctccatacaccgtggttgaatccatgtctctagctaaagctgctgttctctttcgcgaacttggccttagacacttgtgtgtggtgtcgaagacgccagggatgcctcctattgttggaatcttgactcggcacgacttcaccccggagcatgtactggggctttacccacatattaaaccccacaagtag

SEQ ID NO: 68 - protein, 743 aa, Populus trichocarpa
MLREPFLVRNRKNNTSQIAIVGANTCPIESLDYEIAENELLKQDWRSRKKAEIFQYVVLKWTLALLIGLGTGLVGFFNNLAIENIAGFKLLVTNNLMLKEMYYQAFATYAGCNVVLAIAAAALCAYVAPAAAGSGIPEVKAYLNGVDAPSILAPATLFVKIFGSIFGVAAGFVVGKEGPMVHTGACIASFLGQGGSRKYHLTWKWLRYFKNDRDRRDLITCGSAAGVAAAFRAPVGGVLFALEEAASWWRSALLWRTFFTTAVVAVVLRSLIEFCRTGKCGLFGQGGLIMFDVNSTKATYSTPDLVAVMFLGVIGGVFGSFYNYCVDKVLRTYSIINERGPSFKILLVIVISLLTSCCSYGLPWLSQCIPCPPHLAEQCPTESRSGNFKNFQCPPNHYNNLASLFFNTNDDAIRILFTSGSEKEFDLSTLLVFFVAIFCLGIVTYGIAVPSGLFIPVILAGASYGRLVGTLLGPLSNLDVGLFALLGAASFLGGTMRMTVSLCVILLELTNDLLMLPLMMLVLLISKSVADIFNKGVYDQIMKIKGLPYMETHAEPYMRHLIASDVVSGPLVSFSGVEKVGNILHVLRVTRHNGFPVIDEPPYSDAPELCGLVLRSHLLVLLKGKKFTKQRVKTGSDIVRGFKAHDFAKAGSGKGVKLEDLEITEEEMEMYIDLHPIANTSPYTVVESMSLAKAAVLFRELGLRHLCVVSKTPGMPPIVGILTRHDFTPEHVLGLYPHIKPHK

SEQ ID NO: 69 - DNA, 2232 bp, Populus trichocarpa
atgttgagagagccgtttcttgttaggaatataaagaataatacttcacagattgccattgttggtgccaatacctgccctattgaaagccttgattatgagattgctgataatgaactttttagacaagactggaggtctcgaaagaaggttgagatatatcagtatgttgtcctcaagtggacacttgctctcctcattgggttaggtacagggcttgtcggctttttcaataaccttgctgttgaaaacatagctggtttcaaacttctgttgacaaacaatctcatgcttgagaacaagtactatcaggcatttgcaacttatgctggttgcaacgtggttttggctattgctgctgcagccctctgtgcttacgttgctcctgcagcagcaggctctggtatacctgaggttaaagcatacctcaatggtgtagatgctccttctattttggctcctgctaccctctttgtaaagattttcgggtccatatttggagttgctgctggatttgttgttggtaaagaaggacccatggtacatactggtgcttgcatagcctccttacttggacagggtggttctcgcaagtatcatttgacatggaaatggttgagatacttcaaaaatgatcgagaccggcgagatttggttacatgtggttctgctgctggtgtagcagctgccttccgtgctcctgttggcggggtcttatttgcccttgaagaagctgcttcctggtggaggagtgcccttctttggaggacgttctttacgacagctgtagttgcagtcgtattgagaggtctcatagatttttgccgatctggaaaatgtgggctatttggacaaggaggtctgatcatgtttgacgtaaattctagaaaagccttttacagcaccccagatctactagcagttgtgttccttggagtgataggaggcgttttcggaagcctttacaactattgtgtcgacaaggttcttcgcacgtacagcctcatcaatgagaggggtccttcgtttaagatcctgcttgttattgtcatttcccttttgacctcttgttgctcctatggtctcccatggctttcgaagtgcattccctgtccccctcacctggccgagaaatgcccaactgaaggtcgctctggcaacttcaagaatttccagtgtccaccaaaccactacaacgaccttgcttccctcgttttcaacaccaatgatgatgccatccgcaacctattcacttccggtagtgaaaaggaatttcacctctccacccttatagttttcttctttgctatttattgccttggcattgttacttacggcattgctgttccctctgggctcttcatccccgtcattcttgctggggcctcttatgggcgtcttattggaacaatgcttggccctctgtctaatctcgatgcgggtctctgtgccctccttggagctgcctccttccttggtggcaccatgagaatgacagtttctctctgtgtcatacttcttgaacttactaatgatctgcttatgcttccactaataatgctagtgctcctcatttcaaaaacagtggccgatagtttcaacaagggtatttatgatcaaatggtgagaatgaaaggatttccgtacatggaagcccatgcagaaccatacatgagacatcttgttgcaagtgatgttgtttctggtccattagtttcattctctgggattgaaaaagtagggaacctgttgcttgctttgaaagtaacagggcataatggattccctgtgattgatgagccgccttgttcagatgctccagaattgtgtgggcttgtcttgaggtctcatctgcttgtgttgctaagaggaaagaaatttacaaaacagagagtaaagacgggatcagggatcatgaagagtttcaaggcacatgactttgcaaaggctggatcaggcaaaggggtgaagctggaggatttggagatcacagaggaggagatggagatgtatgttgatctccatcctattactaacacatctccatacaccgtggttgaaacaatgtctctagctaaagctgctgttctctttcgcgaacttggccttagacacttgtgtgtggtgccgaagacaccagggaggcctcctattgtcggaatcctgactcggcatgacttcacaccagatcatatactggggctttacccacatattaaacctcacaagtag

SEQ ID NO: 70 - protein, 743 aa, Populus trichocarpa
MLREPFLVRNIKNNTSQIAIVGANTCPIESLDYEIADNELFRQDWRSRKKVEIYQYVVLKWTLALLIGLGTGLVGFFNNLAVENIAGFKLLLTNNLMLENKYYQAFATYAGCNVVLAIAAAALCAYVAPAAAGSGIPEVKAYLNGVDAPSILAPATLFVKIFGSIFGVAAGFVVGKEGPMVHTGACIASLLGQGGSRKYHLTWKWLRYFKNDRDRRDLVTCGSAAGVAAAFRAPVGGVLFALEEAASWWRSALLWRTFFTTAVVAVVLRGLIDFCRSGKCGLFGQGGLIMFDVNSRKAFYSTPDLLAVVFLGVIGGVFGSLYNYCVDKVLRTYSLINERGPSFKILLVIVISLLTSCCSYGLPWLSKCIPCPPHLAEKCPTEGRSGNFKNFQCPPNHYNDLASLVFNTNDDAIRNLFTSGSEKEFHLSTLIVFFFAIYCLGIVTYGIAVPSGLFIPVILAGASYGRLIGTMLGPLSNLDAGLCALLGAASFLGGTMRMTVSLCVILLELTNDLLMLPLIMLVLLISKTVADSFNKGIYDQMVRMKGFPYMEAHAEPYMRHLVASDVVSGPLVSFSGIEKVGNLLLALKVTGHNGFPVIDEPPCSDAPELCGLVLRSHLLVLLRGKKFTKQRVKTGSGIMKSFKAHDFAKAGSGKGVKLEDLEITEEEMEMYVDLHPITNTSPYTVVETMSLAKAAVLFRELGLRHLCVVPKTPGRPPIVGILTRHDFTPDHILGLYPHIKPHK

SEQ ID NO: 71 - DNA, 2358 bp, Populus trichocarpa
atggaggcagattcaagccaattggcagaagcaacagcaggtcataacttggaagttggtgaagaaggaagagacccagaaagcaatacacttcaccagccactcctcaagagaaataggacactatcttctaatccactagccttggttggagccaaggtctcacatatagagagtttggattacgagatcaatgagaatgatcttttcaagcacgattggagaagcagatccaaagttcaagtcttgcagtatatattctggaaatggacattggcctttcttgttggacttttaactggattaattgcaaccttcatcaatcttgcagttgagaacattgctggttacaagattcttgctgtggttcactttatagagaataaaaggtatttgacagggctagtctacttcacaggggctaatcttctcttaaccttatttgcttccgtcctgtgcgtgtgttttgcaccaactgcagcagggcctggtatacctgaaatcaaagcttatctcaatggagttgatactcctaacatgtttggggttacaacattgatcgttaagatatttggaagcataggagctgtctctgctggacttgatttagggaaagaagggcctctggtgcacattggcagctgcattgcttccttgttaggccaagggggacctgataattaccgactcaagtggcgctggcttcgttatttcaacaatgacagagaccgccgagatatcatcacctgcggtgcttcctcgggtgtttgtgcagctttccgttccccagtgggtggtgtcctctttgctcttgaagaggtagcaacatggtggaggagtgcactcctctggagaactttcttcagcacagcagtagttgtggtaatcctcaggactttcattgaaatatgcaattcagggaagtgtggactgtttggaaaaggagggctgataatgttcgatgtgagcgatgttgtggtgacataccatgtgatggatgtcatccctatcaccataattggcatacttggaggaattctgggaagcctctacaattaccttctccacaaggtccttgtagtctacaatctcatcaaccagaagggaagaatacataagctccttctcgccctaactgtttcaatctttacctcagtgtgtctatatggcttacctttccttgccaagtgccaaccttgtgatccctctgtacaagagatctgccctactaattcccggtcaggcaacttcaagcaattcaactgtccagatggccactataatgaccttgctactctccttttcacaacaaatgatgatgccgttcgaaacatcttctcttccaatgctcttaaggagtttcagcctgcatccctcctaattttctttgtactctattgcatcctaggactatttaccttcggcattgctgtgccttcaggacttttcctccccatcatccttatgggctcagcttatggccgtctgcttggtattgccatggggtcctataccaaaattgatcaagggctttatgctgttcttggtgcagcctccctcatggctggatcgatgaggatgactgtttcactctgtgtgattttccttgaactcaccaacaacctcctattacttcccataacaatgatagttctccttatatccaaaactgttggagacagctttaatccaagcatctatgaaattattctggatctaaaaggcctgcctttcttggacgcgaaccctgagccatggatgagaaatctcactgttgctgagcttgctgatgccaaaccaccagtagtcactctttgtggagttgaaaaggtatcccggattgttgaagtcctcgaaaacaccacgcataatggattcccagttgtagacgaaggagtggtgccacttatggggctggccactggggcaacagaactacatggcctgatcctgagagctcacctagttcaagtgctgaagaaaaagtggttcttgccagagaaaagaagaacagaggaatgggaagtaagagagaaatttgactgggttgagctagctgagagggatggaacaattgaagaggtggctgtgacaaggaatgagatggaaatgtatgttgacttgcatcctctcaccaacacaaccccttacacagtcgtggagagcatgtcagtagcaaaagccatggtgctcttcaggcaggtgggacttcgccatatgctcattctacccaagtatcaagcagctggggtccctccagtggttgggatactgaccaggcaggatttaagagcacataacatcttgcttgcctttcctcatttgcaaggatccaaaagcagagaaaagaagcactag

SEQ ID NO: 72 - protein, 785 aa, Populus trichocarpa
MEADSSQLAEATAGHNLEVGEEGRDPESNTLHQPLLKRNRTLSSNPLALVGAKVSHIESLDYEINENDLFKHDWRSRSKVQVLQYIFWKWTLAFLVGLLTGLIATFINLAVENIAGYKILAVVHFIENKRYLTGLVYFTGANLLLTLFASVLCVCFAPTAAGPGIPEIKAYLNGVDTPNMFGVTTLIVKIFGSIGAVSAGLDLGKEGPLVHIGSCIASLLGQGGPDNYRLKWRWLRYFNNDRDRRDIITCGASSGVCAAFRSPVGGVLFALEEVATWWRSALLWRTFFSTAVVVVILRTFIEICNSGKCGLFGKGGLIMFDVSDVVVTYHVMDVIPITIIGILGGILGSLYNYLLHKVLVVYNLINQKGRIHKLLLALTVSIFTSVCLYGLPFLAKCQPCDPSVQEICPTNSRSGNFKQFNCPDGHYNDLATLLFTTNDDAVRNIFSSNALKEFQPASLLIFFVLYCILGLFTFGIAVPSGLFLPIILMGSAYGRLLGIAMGSYTKIDQGLYAVLGAASLMAGSMRMTVSLCVIFLELTNNLLLLPITMIVLLISKTVGDSFNPSIYEIILDLKGLPFLDANPEPWMRNLTVAELADAKPPVVTLCGVEKVSRIVEVLENTTHNGFPVVDEGVVPLMGLATGATELHGLILRAHLVQVLKKKWFLPEKRRTEEWEVREKFDWVELAERDGTIEEVAVTRNEMEMYVDLHPLTNTTPYTVVESMSVAKAMVLFRQVGLRHMLILPKYQAAGVPPVVGILTRQDLRAHNILLAFPHLQGSKSREKKH

SEQ ID NO: 73 - DNA, 2328 bp, Populus trichocarpa
atgtcaacaaattctatcaatagggaagcaaacacagaccaagagtctcttataattcctctcctgtcccctcgaagatcactcattaactccacttctcaagttgccatcgttggagctaatgtctgccccattgaaagtcttgattatgagattgctgagaatgagttctttaaacaagattggaggagtcgtggaaagatgcaaatatttcagtatgtgttcatgaagtggtcgctttgtttcttgatcggacttattgttagccttattgggttttttaacaatcttgctgttgaaaatattgctggcttgaagtttgtggtcacctccaatatgatgctggccaaaaggtttgggatggcttttcttgtgttctcagtttctaatttgattcttaccctgtttgcatccatcatcacggcttttatagcaccagctgctgctggttcaggtattccagaagttaaggcttacctgaatggtgtggatgcacctggaattttttccttgcgaagtttggttattaagattattggaagcatttctgcggtgtcctcgtctctttttgttggaaaggcagggccaatggtgcacactggagcatgtgttgcagcattgcttggtcagggtggatccaagagatttaaattaacatggagatggcttcgttttttcaaaaatgaccgagacagacgggatcttgtaacatgtggatcagctgctggaatagctgctgccttccgtgccccagttggaggtgtgctgtttgcacttgaagaaatggcatcttggtggagaagtgcccttctttggagagctttcttcacaacagcagtagttgcaatagtgcttcgggctctgattgacgtctgtttaagtggaaaatgtgggctatttggaaaaggagggctcataatgtttgatgtgtattcagcaagtgttacgtaccacctcattgatgtaccacctgtgttcgcccttggagttataggaggcatattgggaagtttgtataacttccttctagacaaggttcttcgaatatacaatctcatcaatgagaaaggcgttgtttacaaaattttacttgcttgtgcaatttccattttcacatcctgtcttctttttggactaccatggcttgcctcttgccaaccctgtccatctgatgcgtcggaagcttgtccaacaataggccggtctggtaatttcaagaaatttcaatgtcctcctggacagtacaatgatctggccagccttatatttaacacaaatgatgattctgttaaaaatcttttcagccaggacaccaactctgagtttcaatattcgtcaattctcatattctttgtgacctgcttctttcttagtatctttagctatgggattgttgcccccgcgggtttattcataccagttatcgtgacgggtgcatcttatggacgttttgttggaatgctagttggttcacactcaaatcttgatcacggcctctatgctgtcttaggtgctgcttcatttctaggcggatctatgaggatgacagtttctctgtgtgtcattattctagaattgacaaataatctgttgatgctacccttgataatgcttgttcttcttatttccaagactgtggctgatgctttcaatggtaatatttatgaccttatcatgaatgcgaagggttttccttacctagaagctcacaccgagccttatatgaggcagttgacagttggtgaagtagttaggggtccacttcagatctttcagggcattgaaaaggttggcaaaatagtacatgttctaagaactacgaggcataatggatttcccgtaattgatgagcctccgctttctgagtctccagttctttatggtctaatcctccgtgctcatctaattgaattgctaaagaagaaagcttttgtgccaactccagtaccaacaggcactgatgccttcaagctgttctttgctggtgattttgcaaagaggggctcaggcaatggagacaagatagaggatctgcaatttaccgaagaagagatggagatgtttttagatttacatccatttacgaatgcttcaccttatactgttgcggagacaatgtcactggctaaggctctcatacttttccgagaagttggtttgaggcatttactggtgatacccaagatatctggtaggtcccctgttgtgggtatattgactaggcacgatttcatgccagggcatatacttggtctgcatcctatgctgattagaagcaggtggaaaagattaagaatccaggcacctcgtttattcaaactcttctag

SEQ ID NO: 74 - protein, 775 aa, Populus trichocarpa
MSTNSINREANTDQESLIIPLLSPRRSLINSTSQVAIVGANVCPIESLDYEIAENEFFKQDWRSRGKMQIFQYVFMKWSLCFLIGLIVSLIGFFNNLAVENIAGLKFVVTSNMMLAKRFGMAFLVFSVSNLILTLFASIITAFIAPAAAGSGIPEVKAYLNGVDAPGIFSLRSLVIKIIGSISAVSSSLFVGKAGPMVHTGACVAALLGQGGSKRFKLTWRWLRFFKNDRDRRDLVTCGSAAGIAAAFRAPVGGVLFALEEMASWWRSALLWRAFFTTAVVAIVLRALIDVCLSGKCGLFGKGGLIMFDVYSASVTYHLIDVPPVFALGVIGGILGSLYNFLLDKVLRIYNLINEKGVVYKILLACAISIFTSCLLFGLPWLASCQPCPSDASEACPTIGRSGNFKKFQCPPGQYNDLASLIFNTNDDSVKNLFSQDTNSEFQYSSILIFFVTCFFLSIFSYGIVAPAGLFIPVIVTGASYGRFVGMLVGSHSNLDHGLYAVLGAASFLGGSMRMTVSLCVIILELTNNLLMLPLIMLVLLISKTVADAFNGNIYDLIMNAKGFPYLEAHTEPYMRQLTVGEVVRGPLQIFQGIEKVGKIVHVLRTTRHNGFPVIDEPPLSESPVLYGLILRAHLIELLKKKAFVPTPVPTGTDAFKLFFAGDFAKRGSGNGDKIEDLQFTEEEMEMFLDLHPFTNASPYTVAETMSLAKALILFREVGLRHLLVIPKISGRSPVVGILTRHDFMPGHILGLHPMLIRSRWKRLRIQAPRLFKLF

SEQ ID NO: 75 - DNA, 2310 bp, Populus trichocarpa
atggaggaggatcatagtagtagagaagggaatggatttgagatagaagatgatgatgataaggaacacagtgtgtcaatgttgagagagccgtttcttgttaggaatataaagaataatacttcacagattgccattgttggtgccaatacctgccctattgaaagccttgattatgagattgctgataatgaactttttagacaagactggaggtctcgaaagaaggttgagatatatcagtatgttgtcctcaagtggacacttgctctcctcattgggttaggtacagggcttgtcggctttttcaataaccttgctgttgaaaacatagctggtttcaaacttctgttgacaaacaatctcatgcttgagaacaagtactatcaggcatttgcaacttatgctggttgcaacgtggttttggctattgctgctgcagccctctgtgcttacgttgctcctgcagcagcaggctctggtatacctgaggttaaagcatacctcaatggtgtagatgctccttctattttggctcctgctaccctctttgtaaagattttcgggtccatatttggagttgctgctggatttgttgttggtaaagaaggacccatggtacatactggtgcttgcatagcctccttacttggacagggtggttctcgcaagtatcatttgacatggaaatggttgagatacttcaaaaatgatcgagaccggcgagatttggttacatgtggttctgctgctggtgtagcagctgccttccgtgctcctgttggcggggtcttatttgcccttgaagaagctgcttcctggtggaggagtgcccttctttggaggacgttctttacgacagctgtagttgcagtcgtattgagaggtctcatagatttttgccgatctggaaaatgtgggctatttggacaaggaggtctgatcatgtttgacgtaaattctagaaaagccttttacagcaccccagatctactagcagttgtgttccttggagtgataggaggcgttttcggaagcctttacaactattgtgtcgacaaggttcttcgcacgtacagcctcatcaatgagaggggtccttcgtttaagatcctgcttgttattgtcatttcccttttgacctcttgttgctcctatggtctcccatggctttcgaagtgcattccctgtccccctcacctggccgagaaatgcccaactgaaggtcgctctggcaacttcaagaatttccagtgtccaccaaaccactacaacgaccttgcttccctcgttttcaacaccaatgatgatgccatccgcaacctattcacttccggtagtgaaaaggaatttcacctctccacccttatagttttcttctttgctatttattgccttggcattgttacttacggcattgctgttccctctgggctcttcatccccgtcattcttgctggggcctcttatgggcgtcttattggaacaatgcttggccctctgtctaatctcgatgcgggtctctgtgccctccttggagctgcctccttccttggtggcaccatgagaatgacagtttctctctgtgtcatacttcttgaacttactaatgatctgcttatgcttccactaataatgctagtgctcctcatttcaaaaacagtggccgatagtttcaacaagggtatttatgatcaaatggtgagaatgaaaggatttccgtacatggaagcccatgcagaaccatacatgagacatcttgttgcaagtgatgttgtttctggtccattagtttcattctctgggattgaaaaagtagggaacctgttgcttgctttgaaagtaacagggcataatggattccctgtgattgatgagccgccttgttcagatgctccagaattgtgtgggcttgtcttgaggtctcatctgcttgtgttgctaagaggaaagaaatttacaaaacagagagtaaagacgggatcagggatcatgaagagtttcaaggcacatgactttgcaaaggctggatcaggcaaaggggtgaagctggaggatttggagatcacagaggaggagatggagatgtatgttgatctccatcctattactaacacatctccatacaccgtggttgaaacaatgtctctagctaaagctgctgttctctttcgcgaacttggccttagacacttgtgtgtggtgccgaagacaccagggaggcctcctattgtcggaatcctgactcggcatgacttcacaccagatcatatactggggctttacccacatattaaacctcacaagtag

SEQ ID NO: 76 - protein, 769 aa, Populus trichocarpa
MEEDHSSREGNGFEIEDDDDKEHSVSMLREPFLVRNIKNNTSQIAIVGANTCPIESLDYEIADNELFRQDWRSRKKVEIYQYVVLKWTLALLIGLGTGLVGFFNNLAVENIAGFKLLLTNNLMLENKYYQAFATYAGCNVVLAIAAAALCAYVAPAAAGSGIPEVKAYLNGVDAPSILAPATLFVKIFGSIFGVAAGFVVGKEGPMVHTGACIASLLGQGGSRKYHLTWKWLRYFKNDRDRRDLVTCGSAAGVAAAFRAPVGGVLFALEEAASWWRSALLWRTFFTTAVVAVVLRGLIDFCRSGKCGLFGQGGLIMFDVNSRKAFYSTPDLLAVVFLGVIGGVFGSLYNYCVDKVLRTYSLINERGPSFKILLVIVISLLTSCCSYGLPWLSKCIPCPPHLAEKCPTEGRSGNFKNFQCPPNHYNDLASLVFNTNDDAIRNLFTSGSEKEFHLSTLIVFFFAIYCLGIVTYGIAVPSGLFIPVILAGASYGRLIGTMLGPLSNLDAGLCALLGAASFLGGTMRMTVSLCVILLELTNDLLMLPLIMLVLLISKTVADSFNKGIYDQMVRMKGFPYMEAHAEPYMRHLVASDVVSGPLVSFSGIEKVGNLLLALKVTGHNGFPVIDEPPCSDAPELCGLVLRSHLLVLLRGKKFTKQRVKTGSGIMKSFKAHDFAKAGSGKGVKLEDLEITEEEMEMYVDLHPITNTSPYTVVETMSLAKAAVLFRELGLRHLCVVPKTPGRPPIVGILTRHDFTPDHILGLYPHIKPHK

SEQ ID NO: 77 - DNA, 2298 bp, Populus trichocarpa
atgtcaacaaattctatcaatagggaagcaaacacagaccaagagtctcttataattcctctcctgtcccctcgaagatcactcattaactccacttctcaagttgccatcgttggagctaatgtctgccccattgaaagtcttgattatgagattgctgagaatgagttctttaaacaagattggaggagtcgtggaaagatgcaaatatttcagtatgtgttcatgaagtggtcgctttgtttcttgatcggacttattgttagccttattgggttttttaacaatcttgctgttgaaaatattgctggcttgaagtttgtggtcacctccaatatgatgctggccaaaaggtttgggatggcttttcttgtgttctcagtttctaatttgattcttaccctgtttgcatccatcatcacggcttttatagcaccagctgctgctggttcaggtattccagaagttaaggcttacctgaatggtgtggatgcacctggaattttttccttgcgaagtttggttattaagattattggaagcatttctgcggtgtcctcgtctctttttgttggaaaggcagggccaatggtgcacactggagcatgtgttgcagcattgcttggtcagggtggatccaagagatttaaattaacatggagatggcttcgttttttcaaaaatgaccgagacagacgggatcttgtaacatgtggatcagctgctggaatagctgctgccttccgtgccccagttggaggtgtgctgtttgcacttgaagaaatggcatcttggtggagaagtgcccttctttggagagctttcttcacaacagcagtagttgcaatagtgcttcgggctctgattgacgtctgtttaagtggaaaatgtgggctatttggaaaaggagggctcataatgtttgatgtgtattcagcaagtgttacgtaccacctcattgatgtaccacctgtgttcgcccttggagttataggaggcatattgggaagtttgtataacttccttctagacaaggttcttcgaatatacaatctcatcaatgagaaaggcgttgtttacaaaattttacttgcttgtgcaatttccattttcacatcctgtcttctttttggactaccatggcttgcctcttgccaaccctgtccatctgatgcgtcggaagcttgtccaacaataggccggtctggtaatttcaagaaatttcaatgtcctcctggacagtacaatgatctggccagccttatatttaacacaaatgatgattctgttaaaaatcttttcagccaggacaccaactctgagtttcaatattcgtcaattctcatattctttgtgacctgcttctttcttagtatctttagctatgggattgttgcccccgcgggtttattcataccagttatcgtgacgggtgcatcttatggacgttttgttggaatgctagttggttcacactcaaatcttgatcacggcctctatgctgtcttaggtgctgcttcatttctaggcggatctatgaggatgacagtttctctgtgtgtcattattctagaattgacaaataatctgttgatgctacccttgataatgcttgttcttcttatttccaagactgtggctgatgctttcaatggtaatatttatgaccttatcatgaatgcgaagggttttccttacctagaagctcacaccgagccttatatgaggcagttgacagttggtgaagtagttaggggtccacttcagatctttcagggcattgaaaaggttggcaaaatagtacatgttctaagaactacgaggcataatggatttcccgtaattgatgagcctccgctttctgagtctccagttctttatggtctaatcctccgtgctcatctaattgaattgctaaagaagaaagcttttgtgccaactccagtaccaacaggcactgatgccttcaagctgttctttgctggtgattttgcaaagaggggctcaggcaatggagacaagatagaggatctgcaatttaccgaagaagagatggagatgtttttagatttacatccatttacgaatgcttcaccttatactgttgcggagacaatgtcactggctaaggctctcatacttttccgagaagttggtttgaggcatttactggtgatacccaagatatctggtgtaaggaattctatcctcgctttttgttttttaaaatgtctacttgtagcttacacaaatttaaggcactttacaagttgttgctctgcacttgatattaattaa

SEQ ID NO: 78 - protein, 765 aa, Populus trichocarpa
MSTNSINREANTDQESLIIPLLSPRRSLINSTSQVAIVGANVCPIESLDYEIAENEFFKQDWRSRGKMQIFQYVFMKWSLCFLIGLIVSLIGFFNNLAVENIAGLKFVVTSNMMLAKRFGMAFLVFSVSNLILTLFASIITAFIAPAAAGSGIPEVKAYLNGVDAPGIFSLRSLVIKIIGSISAVSSSLFVGKAGPMVHTGACVAALLGQGGSKRFKLTWRWLRFFKNDRDRRDLVTCGSAAGIAAAFRAPVGGVLFALEEMASWWRSALLWRAFFTTAVVAIVLRALIDVCLSGKCGLFGKGGLIMFDVYSASVTYHLIDVPPVFALGVIGGILGSLYNFLLDKVLRIYNLINEKGVVYKILLACAISIFTSCLLFGLPWLASCQPCPSDASEACPTIGRSGNFKKFQCPPGQYNDLASLIFNTNDDSVKNLFSQDTNSEFQYSSILIFFVTCFFLSIFSYGIVAPAGLFIPVIVTGASYGRFVGMLVGSHSNLDHGLYAVLGAASFLGGSMRMTVSLCVIILELTNNLLMLPLIMLVLLISKTVADAFNGNIYDLIMNAKGFPYLEAHTEPYMRQLTVGEVVRGPLQIFQGIEKVGKIVHVLRTTRHNGFPVIDEPPLSESPVLYGLILRAHLIELLKKKAFVPTPVPTGTDAFKLFFAGDFAKRGSGNGDKIEDLQFTEEEMEMFLDLHPFTNASPYTVAETMSLAKALILFREVGLRHLLVIPKISGVRNSILAFCFLKCLLVAYTNLRHFTSCCSALDIN

SEQ ID NO: 79 - DNA, 2277 bp, Populus trichocarpa
atggaggattatagtaatagagaaaagaatgatttagagatagatgatgataaggaacacagtgtgtcaatgttgagagagccatttcttgttaggaatagaaagaacaatacttcacagattgccattgttggtgctaatacctgccccatcgaaagccttgattatgagattgctgagaatgaacttttgaaacaggactggagatctcgaaagaaggctgagatatttcagtatgttgtcctcaagtggacacttgctctcctcattgggttaggtacagggcttgtcggctttttcaataaccttgccattgagaatatagctggtttcaaacttctgtacaggtactatcaggcatttgcaacttatgctggttgcaatgtggttttggctattgctgctgcagccttatgtgcttatgttgctcctgcggcagcaggatctggtataccagaggttaaagcatacctcaatggtgtagatgctccttctattttggcacctgctaccctttttgtaaagatatttgggtccatatttggggttgctgctggatttgttgttggcaaagaaggacccatggtgcatactggtgcttgcatagcctcctttcttggacagggaggttctcgtaagtatcatttgacatggaaatggctgagatacttcaaaaatgatcgagaccggcgagatttgatcacatgtggttctgctgctggtgtagcagctgccttccgtgctcctgttggcggggtcttatttgcccttgaagaagctgcttcctggtggaggagtgcccttctttggaggacattcttcacaacagctgtagtagcagttgtattgagaagtctcatagaattttgccgaactggaaaatgtgggctgtttggacaaggaggtctgatcatgtttgatgtaaattcgacaaaagctacttatagtaccccagatctagtagcagttatgttccttggagtgataggaggtgtttttggaagcttttacaactattgtgttgacaaggtccttcgcacttacagcatcatcaatgagagaggtccttcgtttaagatcctgcttgttattgtcatttccctgctgacctcttgttgctcctacggcctcccatggctttcacagtgcattccctgtccccctcacctggctgagcaatgccccactgaaagtcgctctggaaacttcaagaatttccagtgtccaccaaaccactataacaatcttgcttccctctttttcaacaccaatgatgatgccatccgcatcttattcacttctggcagcgaaaaagaatttgacctctccacccttctggttttcttcgttgctattttctgccttggcattgttacttatggcattgctgttccctctgggctcttcatcccagtcattcttgctggggcctcttatggccgtcttgttggaacactgctcggtcccctttctaatcttgatgtgggtctctttgcccttcttggagctgcctccttccttggtggcaccatgagaatgacagtttctctttgtgtcatacttctcgaactgactaatgatctgcttatgcttccattaatgatgctagtgctcctcatttcaaaatctgtggctgatattttcaataagggtgtttatgatcaaattatgaaaattaaaggattgccttatatggaaacccatgcagaaccatacatgagacaccttattgcaagtgatgttgtttctggtccattagtttcattctctggggttgaaaaggtagggaacatattacatgtcctgagagtaacaaggcataatggatttcctgtgattgacgagccgccttattcagatgctccagaattatgtgggcttgtcttgaggtctcatctgctcgtgttgcttaaaggaaagaaatttacaaagcagagagtaaagacaggatcagatattgtgaggggtttcaaggcacatgactttgcaaaggctggatcgggcaaaggggtgaagctggaagatttggagatcacagaggaggagatggagatgtatattgatctccatcctattgctaacacatctccatacaccgtggttgaatccatgtctctagctaaagctgctgttctctttcgcgaacttggccttagacacttgtgtgtggtgtcgaagacgccagggatgcctcctattgttggaatcttgactcggcacgacttcaccccggagcatgtactggggctttacccacatattaaaccccacaagtag

SEQ ID NO: 80 - protein, 758 aa, Populus trichocarpa
MEDYSNREKNDLEIDDDKEHSVSMLREPFLVRNRKNNTSQIAIVGANTCPIESLDYEIAENELLKQDWRSRKKAEIFQYVVLKWTLALLIGLGTGLVGFFNNLAIENIAGFKLLYRYYQAFATYAGCNVVLAIAAAALCAYVAPAAAGSGIPEVKAYLNGVDAPSILAPATLFVKIFGSIFGVAAGFVVGKEGPMVHTGACIASFLGQGGSRKYHLTWKWLRYFKNDRDRRDLITCGSAAGVAAAFRAPVGGVLFALEEAASWWRSALLWRTFFTTAVVAVVLRSLIEFCRTGKCGLFGQGGLIMFDVNSTKATYSTPDLVAVMFLGVIGGVFGSFYNYCVDKVLRTYSIINERGPSFKILLVIVISLLTSCCSYGLPWLSQCIPCPPHLAEQCPTESRSGNFKNFQCPPNHYNNLASLFFNTNDDAIRILFTSGSEKEFDLSTLLVFFVAIFCLGIVTYGIAVPSGLFIPVILAGASYGRLVGTLLGPLSNLDVGLFALLGAASFLGGTMRMTVSLCVILLELTNDLLMLPLMMLVLLISKSVADIFNKGVYDQIMKIKGLPYMETHAEPYMRHLIASDVVSGPLVSFSGVEKVGNILHVLRVTRHNGFPVIDEPPYSDAPELCGLVLRSHLLVLLKGKKFTKQRVKTGSDIVRGFKAHDFAKAGSGKGVKLEDLEITEEEMEMYIDLHPIANTSPYTVVESMSLAKAAVLFRELGLRHLCVVSKTPGMPPIVGILTRHDFTPEHVLGLYPHIKPHK

SEQ ID NO: 81 - DNA, 2388 bp, Zea mays
atggacgctaaccactcgccgccggcgcagccggagaggaatcatggcagcttaaactacgacatcgagagcacggacggcacgtggcgcggcgcgggggcgtggcaggagcaggacccatcgtcggaggccctgatgcggtacgacgacgacgggccccgggagccgctgctgcgaaggcgcaccatgaacaccacctcccagattgccatcgtcggcgccaacatctgccccatcgagagcctcgactacgaaattgtggaaaatgaccttttcaagcaggattggcgatcaagaaagaagcagcagatattccagtatattgttctgaaatggtcattagttcttcttattggcctgtgtactggacttgttggcttcttcaataaccttgcagttgaaaacattgctgggttcaagttgttgcttacaagtgatctgatgctcaagcaaaggtacttcacagcatttctggcatatggaggttgcaatctagtcttggcagctgctgctgcagcgatctgcgcttacatagcacctgctgctgctgggtctggtatccctgaagttaaagcataccttaatggagttgatgcttatgctatattagctccaagcacactgtttgtgaagatatttggttcaatacttggagtttcagctggatttgtccttggaaaggaaggtcccatggtacatacaggagcatgcattgccaacttacttggtcaaggggggtcacgcaagtaccatctgacatgtaactggctcagatactttaagaatgatagagataggcgggatttgattacttgtggctctgctgctggagttgcagcagcattccgtgcgcctgttggtggtgtgctctttgctcttgaagaagcagcatcatggtggcgaagtgctctcctgtggagaacattctttacaactgctgttgttgctgttgtactgaggggtctgatccagttctgtcgtagcggaaaatgtggtctttttggtcagggagggttgattatgtttgatcttagctcaaccgtaccgagttacagtacccaggatatcattgcaattattgtccttggaataattggtggggtcttcgggggcctgttcaactttctcttggataggattctccgagcttatagttttatcaacgagagaggtgctccatacaagatccttctcaccgtcacaatatcaatcatcacatcagcatgctcctatgggctaccttggctcgccccatgcactccgtgccctgctgatgctgtggaggaatgccctaccattggccgctctgggaattttaagaactttcagtgcccgccgggctattacaatggtcttgcgtcgttgttcttcaacacaaatgatgacgccatccgcaatctattcagcagtggcaccgagaatgagttccacatgtccactcttttcgtgttcttcactgcgatttactgccttggccttgtgacatacggtattgctgttccatctggtctcttcatccctgttatacttgctggggctacgtacgggcgcatagtggggacccttcttggtccaatttcagaccttgatcctggactattcgcacttcttggcgcggcatctttcctcggtggaacaatgaggatgactgtgtcagtctgcgtgatacttctggagctcaccaatgacctccttatgctcccgttagtcatgctcgttcttctgatatcaaagaccatagccgacagctttaacaaaggggtttatgatcagattgtggtgatgaaaggcttgccattcctggaagctcatgccgaaccatacatgacgcacttggttgctagcgatgttgtgtctgggccactgatctccttttcaggcgtcgagagagtggggaatatcgttcaggcgttgaggatcacaggccacaacggatttccagtggtcgatgagccacctctatcagaggctccagaacttgttgggcttgtgctcagatcccatctgctggtcctgctgaaaggtaagggcttcatgaaagagaagatgaaaaccagcggtagcttcgtgctggaaagatttggtgccttcgattttgccaagccaggctcagggaaaggcctgaagattgaggacctggatttcactgatgaggaaatggacttgtatgtcgatctccatccaattacaaatacatcaccgtacacggtggtagagaccatgtcacttgcgaaggctgccgtccttttccgggcactgggactcaggcacatgctcgttgtgccaaagaccccagggagacctccaattgttggaatcctgacgaggcacgatttcataccggagcatattcatgggctgtttccaaatatacacaagtcacactaa

SEQ ID NO: 82 - protein, 795 aa, Zea mays
MDANHSPPAQPERNHGSLNYDIESTDGTWRGAGAWQEQDPSSEALMRYDDDGPREPLLRRRTMNTTSQIAIVGANICPIESLDYEIVENDLFKQDWRSRKKQQIFQYIVLKWSLVLLIGLCTGLVGFFNNLAVENIAGFKLLLTSDLMLKQRYFTAFLAYGGCNLVLAAAAAAICAYIAPAAAGSGIPEVKAYLNGVDAYAILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIQFCRSGKCGLFGQGGLIMFDLSSTVPSYSTQDIIAIIVLGIIGGVFGGLFNFLLDRILRAYSFINERGAPYKILLTVTISIITSACSYGLPWLAPCTPCPADAVEECPTIGRSGNFKNFQCPPGYYNGLASLFFNTNDDAIRNLFSSGTENEFHMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFNKGVYDQIVVMKGLPFLEAHAEPYMTHLVASDVVSGPLISFSGVERVGNIVQALRITGHNGFPVVDEPPLSEAPELVGLVLRSHLLVLLKGKGFMKEKMKTSGSFVLERFGAFDFAKPGSGKGLKIEDLDFTDEEMDLYVDLHPITNTSPYTVVETMSLAKAAVLFRALGLRHMLVVPKTPGRPPIVGILTRHDFIPEHIHGLFPNIHKSH

SEQ ID NO: 83 - protein, 12 aa, Artificial sequence
  motif 1
  VARIANT (1)..(1): / replace = "Cys" / replace = "Ala" / replace = "Gly" / replace = "Pro"
  VARIANT (2)..(2): / replace = "Tyr" / replace = "Pro" / replace = "Gly"
  VARIANT (3)..(3): / replace = "Val" / replace = "Met"
  VARIANT (4)..(4): / replace = "Gln" / replace = "Asn"
  VARIANT (10)..(10): / replace = "Val" / replace = "Leu"
  VARIANT (11)..(11): / replace = "Ala" / replace = "Phe" / replace = "Ile" / replace = "Val"
  VARIANT (12)..(12): / replace = "Glu"
SHIESLDYEINE

SEQ ID NO: 84 - protein, 19 aa, Artificial sequence
  motif 2
  VARIANT (2)..(2): / replace = "Ala" / replace = "Ser"
  VARIANT (4)..(4): / replace = "Gly" / replace = "Thr"
  VARIANT (6)..(6): / replace = "Ser"
  VARIANT (9)..(9): / replace = "Ser"
  VARIANT (11)..(11): / replace = "Ile"
  VARIANT (13)..(13): / replace = "Gly"
  VARIANT (18)..(18): / replace = "Val"
PTAAGPGIPEVKAYLNGID

SEQ ID NO: 85 - protein, 18 aa, Artificial sequence
  motif 3
  VARIANT (2)..(2): / replace = "Cys" / replace = "Asn"
  VARIANT (4)..(4): / replace = "Cys" / replace = "Phe" / replace = "Leu" / replace = "Ala" / replace = "Ser" / replace = "Thr"
  VARIANT (5)..(5): / replace = "Ser" / replace = "Gly"
  VARIANT (7)..(7): / replace = "Ser" / replace = "Gly"
  VARIANT (8)..(8): / replace = "Ser" / replace = "Gly"
  VARIANT (9)..(9): / replace = "Ser"
  VARIANT (10)..(10): / replace = "Phe"
  VARIANT (11)..(11): / replace = "Ala" / replace = "Leu" / replace = "Val" / replace = "Ile" / replace = "His" / replace = "Phe"
  VARIANT (12)..(12): / replace = "Val" / replace = "Ile"
  VARIANT (15)..(15): / replace = "Ala"
  VARIANT (18)..(18): / replace = "Met"
GSIGAVAAGLDLGKEGPL

SEQ ID NO: 86 - protein, 17 aa, Artificial sequence
  motif 4
  VARIANT (11)..(11): / replace = "Ala" / replace = "Ser" / replace = "Gly"
  VARIANT (12)..(12): / replace = "Ala" / replace = "Leu" / replace = "Met"
  VARIANT (13)..(13): / replace = "Thr" / replace = "Ser"
  VARIANT (14)..(14): / replace = "Ser"
  VARIANT (16)..(16): / replace = "Ser"
  VARIANT (17)..(17): / replace = "Ala"
PVGGVLFALEEVATWWR

SEQ ID NO: 87 - protein, 15 aa, Artificial sequence
  motif 5
  VARIANT (1)..(1): / replace = "Asp"
  VARIANT (2)..(2): / replace = "Arg" / replace = "Asn" / replace = "His" / replace = "Ile"
  VARIANT (5)..(5): / replace = "Met" / replace = "His"
  VARIANT (6)..(6): / replace = "Ala"
  VARIANT (8)..(8): / replace = "Lys" / replace = "Glu" / replace = "Gln"
  VARIANT (11)..(11): / replace = "Phe"
  VARIANT (13)..(13): / replace = "Leu" / replace = "Ile"
  VARIANT (14)..(14): / replace = "Tyr" / replace = "Trp"
GKCGLFGSGGLIMFD

SEQ ID NO: 88 - protein, 5 aa, Artificial sequence
  motif 6
  VARIANT (3)..(3): / replace = "Asn" / replace = "Gly" / replace = "Ala"
  VARIANT (4)..(4): / replace = "Met"
  VARIANT (5)..(5): / replace = "Ala"
YNDLS

SEQ ID NO: 89 - protein, 9 aa, Artificial sequence
  motif 7
  VARIANT (2)..(2): / replace = "Thr"
  VARIANT (3)..(3): / replace = "Leu"
  VARIANT (5)..(5): / replace = "Thr"
  VARIANT (9)..(9): / replace = "Val" / replace = "Thr"
GSMRMTVSL

SEQ ID NO: 90 - protein, 15 aa, Artificial sequence
  motif 8
  VARIANT (2)..(2): / replace = "Ile" / replace = "Leu" / replace = "Val" / replace = "Met"
  VARIANT (5)..(5): / replace = "Phe" / replace = "Val"
  VARIANT (6)..(6): / replace = "Val"
  VARIANT (7)..(7): / replace = "Ser"
  VARIANT (9)..(9): / replace = "Ala" / replace = "Ser"
  VARIANT (10)..(10): / replace = "Ile"
  VARIANT (11)..(11): / replace = "Ala"
  VARIANT (12)..(12): / replace = "Asn"
  VARIANT (13)..(13): / replace = "Ala" / replace = "Phe" / replace = "Ile" / replace = "Cys" / replace = "Asn" / replace = "Gly" / replace = "Val"
MFVLLIAKTVGDSFN

SEQ ID NO: 91 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 92 - DNA, 53 bp, Artificial sequence
  primer: prm13490
ggggacaagtttgtacaaaaaagcaggcttaaacaatggaggaggagcagagc

SEQ ID NO: 93 - DNA, 50 bp, Artificial sequence
  primer: prm13491
ggggaccactttgtacaagaaagctgggtctcaaaaatggttcctctcaa

SEQ ID NO: 94 - DNA, 864 bp, Oryza sativa
atggctaggtctctcgctgctctccttctccttctggtcgcagccgcgggagccagccatgccgcgtcgccggcggagatgtactggaagatcgcgctcccgacctcgccgatgcccggcgccattcgcgacctcatcagcccggcgagctcagcggcctcagcttcgaaggataaggaggatacggtgggctccgtgttcttcctcgagaaggacctcttcccgggctccaagatgacgctccacttcacccgcgccaccgccggcgccgcgctgctccctcgcggccgcgccgactccgtcccgttcgcctccgaaaagctcccggagatcctctcccagctctccatccccgccggctcgccgaccgccgacgccatgcggtccacgctcgccgtgtgcgaggccgcgcggatcgccagcgagacggcgcccaagcacaagcactactgcgccacgtcgctcgagtccatggtcgagctcgtcgcctccagcctcggcacccgcgacgtccacgccgtgtccacggaggtggtcaacagggccgggccgacgccgaggcaggcgtacagggtggaggccgtgaggcccgtgccggtgcccgggggcgacatggtggcatgccacaggatgccctacgcgtacgccgtgttcggggtgcacgggatcaagggcgcggcgtacacggtgacgctggccggcgccgacgggaccatggcggaggcggtggcggcgtgccacggggacgtggacgggcacggcgtggcggtggcggaggcgtacaagaggctcggcgtggcgcccgggaaggtggcagtctgccacttcctgcctcaggacgacatgctctgggtgcgcaactga

SEQ ID NO: 95 - protein, 287 aa, Oryza sativa
MARSLAALLLLLVAAAGASHAASPAEMYWKIALPTSPMPGAIRDLISPASSAASASKDKEDTVGSVFFLEKDLFPGSKMTLHFTRATAGAALLPRGRADSVPFASEKLPEILSQLSIPAGSPTADAMRSTLAVCEAARIASETAPKHKHYCATSLESMVELVASSLGTRDVHAVSTEVVNRAGPTPRQAYRVEAVRPVPVPGGDMVACHRMPYAYAVFGVHGIKGAAYTVTLAGADGTMAEAVAACHGDVDGHGVAVAEAYKRLGVAPGKVAVCHFLPQDDMLWVRN

SEQ ID NO: 96 - DNA, 780 bp, Oryza sativa
atggctaggtcactcgctgctctcctactccttctggtcgccgccgcgggagacagccatgccgcgtcgccagcggagatgtactggaagatcgcgctcccgacctcgccgatgcccggcgccatccgcgacctcatcaacccggcgagctcagcggggtcagcttcgaaggaggacacggtgggcaacgtgttcttcctcgagaaggacctcttcccgggctccaagctgacgctccacttcacccgcgccaccgccggcgccgcgctgctcccccgcggccgcgccgactccgtcccgttggccaccgaaaagctcccggagatcctctcccagctctcctgcgaggccgcgccgctcgccggcgaggcgaagcaatgcgcgacgtcgctcgagtccatggtggagttcgccgcgtccagcctcggcacccgcgacgtgcacgccgtgtccacggaggtcgacagggcagggccggcgccgaggcaggcgtacagggtggaggccgtgaggcccgtgccggtgtccggcggcgacatggtggcgtgccacggcatggcctacgcgtacgccgtgttcgggtgccacacgaccacggcggcggcgtacacggtggcgctctccggcgccgacgggactagggcggaggcgctcgcggcgtgccacgccgacgcggcgccgggggtggcggaggcgtacaagaggctcggcgtggcgcccgggagcgtgccggtgtgccacttcttgccacaggacgacatgctctgggtgcgtaactga

SEQ ID NO: 97 - protein, 259 aa, Oryza sativa
MARSLAALLLLLVAAAGDSHAASPAEMYWKIALPTSPMPGAIRDLINPASSAGSASKEDTVGNVFFLEKDLFPGSKLTLHFTRATAGAALLPRGRADSVPLATEKLPEILSQLSCEAAPLAGEAKQCATSLESMVEFAASSLGTRDVHAVSTEVDRAGPAPRQAYRVEAVRPVPVSGGDMVACHGMAYAYAVFGCHTTTAAAYTVALSGADGTRAEALAACHADAAPGVAEAYKRLGVAPGSVPVCHFLPQDDMLWVRN

SEQ ID NO: 98 - DNA, 1336 bp, Oryza sativa
gtgctcagtttcactcttatcagtgaattagatcatatacttgtgtccttgatagctcgttaattagcatggctaggtcactcgctgctgtcctactccttttggtcgccgccgcgggagccagccatgccgcgtcgccggcggagatgtactggaagatcgcgctcccgacctcgccgatgcccggcgccattcgcgacctcatcagcccagcgagctcagtgggctcagcttcgaaggaggacacggtgggcaacgtgttcttcctcgagaaggacctcttcccgggctccaagatgacgctccacttcacccgcgccaccgccggcgccgcgctgctcccccgcggccgcgccgagtccgtcccgttcgcctccgaaaggctcccggagatcctctcccagctctccatcccggccgtctcgccgaccgccgacgccatgtggtccacgctcgccgagtgcgaggccgcgcggctcgccggcgagacgaccaagcacaagcactactgcgccacgtcgctcgagtccatggtcgagttcgtcgcgtccagcctcggcacccgcgacgtccacgccgtgtccacggaggtgatcagcacgttgacgccgacgccgaggcaggcgtacagggtggaggccgtgaggcccgtggcggtgcccggcggcgacatggtggcatgccacgggatgccgtacgcgtacgccgtgttcgggttgcacgggctcaagggcgcaggcggtggccgcgtgccacggggacgtggacgggcacggcgcggtggcggaggcatacaagaggctcggcgtggcgcccgggagcgtggccatctgccacttcctgcctcaggacgacatgatctgggtgcgcaactgaattaatgaagcagctaccttgcgcgccatccatggctaattattttagacatgctccttcctatattttggatctacctgccggctatcatgttatcataaatttacgcgtgtgcgcgcgacgatccgacatgcccacactaacgtgttttactttgttaattaataagtctgcatacccaggtcatcttgtacggtgctactccctctatcccgaaataaaacaacttatagagattgaagtttgtcccaaaataaaccaacttctaccttcttgcctaccatcaatgcctaccacctgtctgcaaaacaataaattttattacttcaataccccgggttggttcatgtgcagtacttaggacaagttttgtagtagatgtaaataccacatctaatttaagtcatgtcatcttctcattaattaaaagatagcaagtgcaacatattgcacttttctt

SEQ ID NO: 99 - protein, 270 aa, Oryza sativa
MARSLAAVLLLLVAAAGASHAASPAEMYWKIALPTSPMPGAIRDLISPASSVGSASKEDTVGNVFFLEKDLFPGSKMTLHFTRATAGAALLPRGRAESVPFASERLPEILSQLSIPAVSPTADAMWSTLAECEAARLAGETTKHKHYCATSLESMVEFVASSLGTRDVHAVSTEVISTLTPTPRQAYRVEAVRPVAVPGGDMVACHGMPYAYAVFGLHGLKGAGGGRVPRGRGRARRGGGGIQEARRGARERGHLPLPASGRHDLGAQLN

SEQ ID NO: 100 - DNA, 870 bp, Oryza sativa
atgcacacatatcgctctttatatcggttagctagcacagaaacggagggagtcgccgccgcgagagccagccatgccgcgtcgccggcggagctgtactggaagatcgcgctcccgacctcgccgatgcccggcgccattcgcgacctcatcaaccctgcgaggtcagcttcgcaggaggacacggacatggacgaggtgagcacggacgcggtgttcttcctcgagaaggacctgttcccgggctccaagatcacgctccacttcacccgcggcggcgcctgcgccatggtgctcctccgtggccgcgccgacgccatcccgttcgcctccgagaagctcccggagatcctcacccagctctccgtccccgccggctcacgcgccgccgaggacatgcggaccaccctcgccgagtgcgaggccgcgctgctcggcgcccgcgaccaggccaagcactgcgtgacgtcgctcgagtccatggtcgagttcgccgccgccagcctcggcacccgcgacatccgcgccgtctccacggaggtgatcggcacgggggcggcggagacgccgaggcaggagtacacggtggaggccgtgaagcccgtcgtgtctgtctccggcggcaacatggtgacgtgccacgggatgccctacgcgtacgccgtgttcgggtgccacacgaccacggccaccgcgtacgcggtgacgctcgccggtgccgatgggacccgggcggaggcgctcgcgacgtgccacggcgacgcgttccccggcgtggcggaggcgtacgagagggtcggcgtggcggccgggagcgtgccggtgtgccacatcatgccgctgggcgacatgctgtgggtgcgcaactga

SEQ ID NO: 101 - protein, 289 aa, Oryza sativa
MHTYRSLYRLASTETEGVAAARASHAASPAELYWKIALPTSPMPGAIRDLINPARSASQEDTDMDEVSTDAVFFLEKDLFPGSKITLHFTRGGACAMVLLRGRADAIPFASEKLPEILTQLSVPAGSRAAEDMRTTLAECEAALLGARDQAKHCVTSLESMVEFAAASLGTRDIRAVSTEVIGTGAAETPRQEYTVEAVKPVVSVSGGNMVTCHGMPYAYAVFGCHTTTATAYAVTLAGADGTRAEALATCHGDAFPGVAEAYERVGVAAGSVPVCHIMPLGDMLWVRN

SEQ ID NO: 102 - DNA, 720 bp, Oryza sativa
atgcccggcgccattcgcgacctcatcaacccagtgagctcagcggcctcagcttcgaaggaggacacggtgaacaacgtgttcttcctcgagaaggacctcttcccgggctccaagatgacgctccacttcacccgcgccaccgccggcgccgcgctgttgccccgcggccgcgccgactccgtcccgttcgcctccgaaaagctcccggagatcctctcccagctctccgtccccgccggctccccggccgccgacgccatgaggtccaccctcgccgagtgcgaggccgcgccgcaggccggtgaggccaagcgctgcgcgacgtcgctcgagtccatggtggagttcgccgcgtccagcctcggcacccgcgacgtgcacgccgtgtccacggaggtcgacagggcagggccgacgccgaggcaggcgtacagggtggaggccgtgaggcccgtgccggtgtccggcggcgacatggtggcgtgccacggcatggcctacgcgtacgccgtgttcgggtgccacacgaccacggcggcggcgtacacggtgacgctggccggcgccgacgggaccaaggcggaggcgctcgcggcgtgccacaccgacgcggcgcccagggtggcggaggcgtacaagaggctcggcgtggcgcccgggagcgtgccggtgtgccacttcctgccacaggacgacatgctctgggtgcgcaactga

SEQ ID NO: 103 - protein, 239 aa, Oryza sativa
MPGAIRDLINPVSSAASASKEDTVNNVFFLEKDLFPGSKMTLHFTRATAGAALLPRGRADSVPFASEKLPEILSQLSVPAGSPAADAMRSTLAECEAAPQAGEAKRCATSLESMVEFAASSLGTRDVHAVSTEVDRAGPTPRQAYRVEAVRPVPVSGGDMVACHGMAYAYAVFGCHTTTAAAYTVTLAGADGTKAEALAACHTDAAPRVAEAYKRLGVAPGSVPVCHFLPQDDMLWVRN

SEQ ID NO: 104 - DNA, 1089 bp, Triticum aestivum
atggcgcgcttcctcgtcgccctcctcgctgccaccctggtcgcggttcaggctggagggcagctgggccacgcggcgccggctacgggggaggtgttctggcgcgccgtgctgccgcactcgccattgcctgacgccgttctccgcctcctcaaacaacctgcagcagaatccaccagcttcgtgagagaccccgaggacaggccccccttcgactaccgtgattacagccgctcgtcgtccgatgatgaaccgagcaagagcaccgtcgccgcctccggagcggggggcttcgactacgacaactacagcggggccgacgaacgtcgtggtgccaccgatgaatacaaggcgccgagcagcagcctcgctggaagcggggcgtacatggctaggggcggcaaggcggagacgacgacggtgttctttcacgaggaggcggtgcgcgtcggcaggaggctcccattccacttcccgccggcgactcccgccgctctcggtttcctgccgcgccaggtcgccgactccgtcccgttcacgacggccgcgctgcccggcatcctcgcgacgtttggcatcgcgtccgactccaccacggtgcccagcatggaggcgacgctgcgcgcctgcgagtcgcccaccatcgccggggagtccaagttctgcgcgacttcgctggaggccctggtggagcgcgccatgggagtgctggggacccgggacatcaggccggtgacgtcgacgctgccccgcgccggcgccccgctgcagacgtacaccgtcgtcgccgtgcagccggtggagggggggcctgtcttcgtggcgtgccacgacgaggcctacccgtacaccgtgtaccggtgccacaccaccggcccgtccagggcgtacacggtggacatggagggcgcgcgcggcgccgacgcggtgaccatcgccgccgtgtgccacaccgacacgtccctgtggaacccggagcacgtctccttcaagctcctcggcaccaagcccggcggcacgccggtctgccacctcatgccgtacgggcacataatctgggccaagaacgtgaagcgctcgccggcgtga

SEQ ID NO: 105 - protein, 362 aa, Triticum aestivum
MARFLVALLAATLVAVQAGGQLGHAAPATGEVFWRAVLPHSPLPDAVLRLLKQPAAESTSFVRDPEDRPPFDYRDYSRSSSDDEPSKSTVAASGAGGFDYDNYSGADERRGATDEYKAPSSSLAGSGAYMARGGKAETTTVFFHEEAVRVGRRLPFHFPPATPAALGFLPRQVADSVPFTTAALPGILATFGIASDSTTVPSMEATLRACESPTIAGESKFCATSLEALVERAMGVLGTRDIRPVTSTLPRAGAPLQTYTVVAVQPVEGGPVFVACHDEAYPYTVYRCHTTGPSRAYTVDMEGARGADAVTIAAVCHTDTSLWNPEHVSFKLLGTKPGGTPVCHLMPYGHIIWAKNVKRSPA

SEQ ID NO: 106 - DNA, 2109 bp, Hordeum vulgare
atggatttgtttctgccactcctctcatttcttttgattcttggaggacaaggtagccatcatgcaagttttgccgatgcgcccaagatgactttgacaaacatggagacgctgatggcatactgggaggcggcgcttccaggaattccgattcccgcagctataagcgacctgttagcccaacaaaaagggctgccaaaaattggaccaaactatgagagagtcaagtcagaagctggtcacagggaaaaccatgttcatatcatatcacaagttgaagatgatttaaaagaggcccatgggtatcatggtgaacaaggtataaagaaggtcgtgatggcacatgagccaaacattggtaagcatctgaagagacaaccattctcagatgggttacaagctaagaattatgtagaagaacaaattgctgggcatagaacaaaaatcgaagaaaatctaaaggaaatatcagtgtcatatgggtcagaaggtgatcataattataagaaagttccactaaatttgaagaagatcgttgcagcatatacaccattgaaagataaaagccttaaggaaatatctgtgtcatatggattaaaagttggagaagcccacaaagaagtttcagggtcgtatggtttagaaagtgaaaataatttaaaagaaatatcactgtcatatggtgtaaacagtgatgatactccaaaggaagagtcgccacatgaagagaatgtaaatgaaatctcagtgtcatatgggttagaaggttcaaagagtttaaagaaagttccactaaatttaaagaaaatcctggtagcacacacaccttggaaagatggaaatctaaaggaaatatctgtatcatatggatcaaaaggccaagagatttcaaaggaagcaaaaggaatatttgggttaaaaggtgaaaaggatttgaaagaaatctcggtgtcttatggtgttgatgaccatgaaaatatgaaggaaatatctgtgacatacggatcaaaagatcaagaaactctaaaggaatcctcaggatcatatgggtttgaaggtaaaaaggatttaaaagaaatttcagtgtcttatggcgcgggcggccatgaaaatctgaaggaaatatccgtatcatatggatcaaaggaccaaaaaaatcacaaggaaggagaaggatcttatgcgttgaaaggtgaaactgatataaaagaaatctcagtgtcctatggtgtagacagccaggagtttgtaaagggattatccccatcacacgaagaaaatccaaaggaagtcacgatttcatatgggtcaattgaagataaagatgaacaagtcgacgctctgcataaagtaaaaggagaggggagccaccatgttcacactcacagctacaagaacaagaaagaggcagatgtctttttcttccaagacatgttgaggccagggtccttgatcaccccgaccatcccgccgactacctccatgccggcgcttctctcaggcgacgtcgccgactccatcccgttctccgccgagcacctctcagacatcatcacaatgttcgcaccggcgtccctcgccatgaccagagagatacggtggacgctggacacctgcgagcacccacggacgctccccggccagaaagcaggctgcgccacctccctcgagtccctcgccgagctgccggcgtccctccttgggaggcgtaacatccgtgcgttctccgccatggatctacccatggatgccccagggacaccggcgcttaggggtaagtacaacgtgacggctgcacggaagctctccgggtcatcatctgaggtcgtgacctgccatgacctgacctacccttacgcggtgtactactgccacacatccagccctacggccgcctacatggtgacactgacgagcgtggaggaggatacctcgccggcgacgatggaggtcatggccgtgtgccaccttgacacgtcattgtggagcccgaagaatccgttctttgagctgcacaaagttgggccaggtgatgtggccgtgtgccactttctcactaagctgagcatcatctgggtgtcagttgacgggcatgtcgacgcactgtag

SEQ ID NO: 107 - protein, 702 aa, Hordeum vulgare
MDLFLPLLSFLLILGGQGSHHASFADAPKMTLTNMETLMAYWEAALPGIPIPAAISDLLAQQKGLPKIGPNYERVKSEAGHRENHVHIISQVEDDLKEAHGYHGEQGIKKVVMAHEPNIGKHLKRQPFSDGLQAKNYVEEQIAGHRTKIEENLKEISVSYGSEGDHNYKKVPLNLKKIVAAYTPLKDKSLKEISVSYGLKVGEAHKEVSGSYGLESENNLKEISLSYGVNSDDTPKEESPHEENVNEISVSYGLEGSKSLKKVPLNLKKILVAHTPWKDGNLKEISVSYGSKGQEISKEAKGIFGLKGEKDLKEISVSYGVDDHENMKEISVTYGSKDQETLKESSGSYGFEGKKDLKEISVSYGAGGHENLKEISVSYGSKDQKNHKEGEGSYALKGETDIKEISVSYGVDSQEFVKGLSPSHEENPKEVTISYGSIEDKDEQVDALHKVKGEGSHHVHTHSYKNKKEADVFFFQDMLRPGSLITPTIPPTTSMPALLSGDVADSIPFSAEHLSDIITMFAPASLAMTREIRWTLDTCEHPRTLPGQKAGCATSLESLAELPASLLGRRNIRAFSAMDLPMDAPGTPALRGKYNVTAARKLSGSSSEVVTCHDLTYPYAVYYCHTSSPTAAYMVTLTSVEEDTSPATMEVMAVCHLDTSLWSPKNPFFELHKVGPGDVAVCHFLTKLSIIWVSVDGHVDAL

SEQ ID NO: 108 - DNA, 1179 bp, Arabidopsis thaliana
atggcgattcgtcttcctctgatctgtcttcttggttcattcatggtagtggcgattgcggctgatttaacaccggagcgttattggagcactgctttaccaaacactcccattcccaactctctccataatcttttgactttcgattttaccgacgagaaaagtaccaacgtccaagtaggtaaaggcggagtaaacgttaacacccataaaggtaaaaccggtagcggaaccgccgtgaacgttggaaagggaggtgtacgcgtggacacaggcaagggcaagcccggaggagggacacacgtgagcgttggcagcggaaaaggtcacggaggtggcgtcgcagtccacacgggtaaacccggtaaaagaaccgacgtaggagtcggtaaaggcggtgtgacggtgcacacgcgccacaagggaagaccgatttacgttggtgtgaaaccaggagcaaaccctttcgtgtataactatgcagcgaaggagactcagctccacgacgatcctaacgcggctctcttcttcttggagaaggacttggttcgcgggaaagaaatgaatgtccggtttaacgctgaggatggttacggaggcaaaactgcgttcttgccacgtggagaggctgaaacggtgccttttggatcggagaagttttcggagacgttgaaacgtttctcggtggaagctggttcggaagaagcggagatgatgaagaagaccattgaggagtgtgaagccagaaaagttagtggagaggagaagtattgtgcgacgtctttggagtcgatggtcgactttagtgtttcgaaacttggtaaatatcacgtcagggctgtttccactgaggtggctaagaagaacgcaccgatgcagaagtacaaaatcgcggcggctggggtaaagaagttgtctgacgataaatctgtggtgtgtcacaaacagaagtacccattcgcggtgttctactgccacaaggcgatgatgacgaccgtctacgcggttccgctcgagggagagaacgggatgcgagctaaagcagttgcggtatgccacaagaacacctcagcttggaacccaaaccacttggccttcaaagtcttaaaggtgaagccagggaccgttccggtctgccacttcctcccggagactcatgttgtgtggttcagctactag

SEQ ID NO: 109 - protein, 392 aa, Arabidopsis thaliana
MAIRLPLICLLGSFMVVAIAADLTPERYWSTALPNTPIPNSLHNLLTFDFTDEKSTNVQVGKGGVNVNTHKGKTGSGTAVNVGKGGVRVDTGKGKPGGGTHVSVGSGKGHGGGVAVHTGKPGKRTDVGVGKGGVTVHTRHKGRPIYVGVKPGANPFVYNYAAKETQLHDDPNAALFFLEKDLVRGKEMNVRFNAEDGYGGKTAFLPRGEAETVPFGSEKFSETLKRFSVEAGSEEAEMMKKTIEECEARKVSGEEKYCATSLESMVDFSVSKLGKYHVRAVSTEVAKKNAPMQKYKIAAAGVKKLSDDKSVVCHKQKYPFAVFYCHKAMMTTVYAVPLEGENGMRAKAVAVCHKNTSAWNPNHLAFKVLKVKPGTVPVCHFLPETHVVWFSY

SEQ ID NO: 110 - DNA, 1164 bp, Brassica napus
atggcgattcgtctttcgttgatatgccttcttgtttcagtcacggccattgcggctgatttaacgccggagcgttattggaactctgccttaccaaacactcccataccaaactctcttcgccatctttttacgtcagattttagcgacgaggaaagcaccaacgtccaagtagggaaaggaggcgtgaacgtttacaccggaaaaggtaagcctggcggaggaaccgccgtgaacgttggaaagggaggtgtacatgtgaacaccggcaagggtaagggaacacacgtgagcgttagcggtggaaaaggccacggaggaggcgtcggcgtccacaccgggaagccaggaaagagaaccgacgtaggagttggcaaaggtggcgttatagtgcacacgcgccacaagggaaagccggtctacgtcggggtgaaaccaggacataacccttttgcgtataactatgcagcgagcgagactcagctccacgacgatcccaaagctgctctcttcttcttggagaaagacatggttcccggaaaagctatgaacctcaggtttaatgcggaggacggctacaacggcaaaaccgcgttcttgccacgtggagaggcggaaacggtgccgttcgggtctgagaagtcctcggagatcttgaacacgttctcggtgaaacctggctcgggagaagcagagatgatgaagaaaacgattgaggagtgtgaagcgaaaagagtcggtggcgaagagaagtattgtgctacgtctttggagtcgatggtggacttcagcgtttctaaacttggcaaagatcacgttcgtgctgtctccactgaggtggctgagaagaatgcaccgatgcaaaagtacagaatcgcggcggctggggtaaagaagttgtcagacgacaagtcggtggtgtgtcacaaacagaagtacccattcgctgtgttctactgccacaaggcgatgatgacgagcgtttacgcggttcccctcgaaggagagaacgggttgcgtgctaaagcggttgcggtatgtcacaagaacacctcggcgtggaacccaaaccacttggcctttaaagtccttaaggtgaagcctgggagtgttccggtctgccatttcctccctgaaacccatgttgtttggttcagctactag

SEQ ID NO: 111 - protein, 387 aa, Brassica napus
MAIRLSLICLLVSVTAIAADLTPERYWNSALPNTPIPNSLRHLFTSDFSDEESTNVQVGKGGVNVYTGKGKPGGGTAVNVGKGGVHVNTGKGKGTHVSVSGGKGHGGGVGVHTGKPGKRTDVGVGKGGVIVHTRHKGKPVYVGVKPGHNPFAYNYAASETQLHDDPKAALFFLEKDMVPGKAMNLRFNAEDGYNGKTAFLPRGEAETVPFGSEKSSEILNTFSVKPGSGEAEMMKKTIEECEAKRVGGEEKYCATSLESMVDFSVSKLGKDHVRAVSTEVAEKNAPMQKYRIAAAGVKKLSDDKSVVCHKQKYPFAVFYCHKAMMTSVYAVPLEGENGLRAKAVAVCHKNTSAWNPNHLAFKVLKVKPGSVPVCHFLPETHVVWFSY

SEQ ID NO: 112 - DNA, 2241 bp, Oryza sativa
atccttcgtagtgcaattcacttatacacggagtttaattagtttattgccttctacaatggataggatcttcgcccgtttcttttgcttcctactgattgcggcagtaagccatgcagctgatctgtcccccgagcaatactggcgatccatcctccctaacaccccaatgccaagctccatctcccaacttcttaactacccttacttgcctgctgttagattacctcgccgtacggatgctggtcagcgcaactacaaatcatcagtttcacatgtggctgaacgatctcaccgtgtagatgatggccaacgcaactacaagttatcagctttacctgccactaatgaactacctcaccgtacggatgctggtcaacgcaactacaagtcatcagtttcacctgtggctgaactacctcaccgtgtagatgatggccaacgcaactacaagttatcagctttacctgccactaatgaactacctcaccgtacggatgctggtcaacgcaactacaagtcatcagtttcacctrtggctgaactayctcaccgtgtagatgatggycaacgcaactacaagttatcagctttacctgccactaatgaactacctcaccrtacggatgctggtcaacgcaactacaagtcatcagtttcacctatggctgaactayctcaccgtgtagatgatggtcaacgcaactacaagttatcagctttacctgccactaatgaactacctcaccrtacggatgctggtcaacgcaactacaagtcatcagtttcacctgtggctgaactacctcaccgtgtagatgatggtcaacgcaactacaagttatcagctttacctgccactaatgaactacctcaccgtacggatgctggtcaacgcaactacaagtcatcagtttcacctgtggctgaactacctcaccgtgtagatgatggccaacgcaactacaagttatcagctttacctgccactaatgaactacctcaccgtatagatgctggtcaacgcaactacaagtcatcagtttcacctatggctgaactacctcaccgtgcagatgatggtcaacgcaactacaagttatcagtttcacctgctgctgaactacctcaccgtgtagatgatggtcaacgcaattacaagttatcagttttacctgccactgaactagttcactatacagatggtcaacgcaattacaagtcatcagttttggagacgccagaacttctcaaagaccccgacatggcgctcttcttccttgagaagaatcttcaacaaggtaaaaaaattaataacgccctccacttcgccaacttgttggccactacgaactccaagttcctgccacgaggcaaggcggactccatcccgttctcctctaaagaactacccgagatcctggaccggttcggggtgcggccgggctccgacgacgcggctgagatgagtgctacgctgcaggactgcgagctgccggcgaataagggagagaagaaggcctgcgccacgtcgctggagtctatagtcgacttcgtcacatccagctttggggccagtgacgtcgacgccgcctccaccgttgtgctcagtaaggcggtggagtcttcttcgctggcgcaggactacacggtgagcggcgtgaggcgaatggccggaaccggccagctcatcgcttgccatccggagtcgtacccgtacgctgtgttcatgtgccacctcacagaggcgacgacgagggcgtacaaggcctcattggtcggcaaagatggtactgcggtggaggcggtcgccgtgtgccacaccgacacgtcggactggaacccagagcacgctgccttccatgtgctcggcgtcaagcctgggactgtgcctgtctgccacttcatgcagcctgacgctgtcgtctggacccgcaggggctgatgtatgtatgtatgccatatagtacctacttcatcgtactgtactgcgtacgcatgctgccagctgctttgcataccttgctgctggagatatataattaatatccagcacttatatactcgtcacttctatcgtgtgtcgaaggttatatacttgtagcatttggggatgcagtacgtacgtgtgtctgtaataagtttcgtgatatgttgcttcatccatatggaccatatgtaccaccaatcccagtgatatataataatataatatcgttgtctagtactacttgcttatct

SEQ ID NO: 113 - protein, 628 aa, Oryza sativa
  misc_feature (160)..(160): Xaa can be any naturally occurring amino acid
  misc_feature (164)..(164): Xaa can be any naturally occurring amino acid
  misc_feature (170)..(170): Xaa can be any naturally occurring amino acid
  misc_feature (188)..(188): Xaa can be any naturally occurring amino acid
  misc_feature (207)..(207): Xaa can be any naturally occurring amino acid
  misc_feature (231)..(231): Xaa can be any naturally occurring amino acid
MDRIFARFFCFLLIAAVSHAADLSPEQYWRSILPNTPMPSSISQLLNYPYLPAVRLPRRTDAGQRNYKSSVSHVAERSHRVDDGQRNYKLSALPATNELPHRTDAGQRNYKSSVSPVAELPHRVDDGQRNYKLSALPATNELPHRTDAGQRNYKSSVSPXAELXHRVDDXQRNYKLSALPATNELPHXTDAGQRNYKSSVSPMAELXHRVDDGQRNYKLSALPATNELPHXTDAGQRNYKSSVSPVAELPHRVDDGQRNYKLSALPATNELPHRTDAGQRNYKSSVSPVAELPHRVDDGQRNYKLSALPATNELPHRIDAGQRNYKSSVSPMAELPHRADDGQRNYKLSVSPAAELPHRVDDGQRNYKLSVLPATELVHYTDGQRNYKSSVLETPELLKDPDMALFFLEKNLQQGKKINNALHFANLLATTNSKFLPRGKADSIPFSSKELPEILDRFGVRPGSDDAAEMSATLQDCELPANKGEKKACATSLESIVDFVTSSFGASDVDAASTVVLSKAVESSSLAQDYTVSGVRRMAGTGQLIACHPESYPYAVFMCHLTEATTRAYKASLVGKDGTAVEAVAVCHTDTSDWNPEHAAFHVLGVKPGTVPVCHFMQPDAVVWTRRG

SEQ ID NO: 114 - DNA, 1764 bp, Oryza sativa
aaaggcccatcacctgcatcgttccaagcgcagctcaatctttgcctcgtcaggttttgctcattggcgtctccatggataggctcctcgcctgcctccttggcttcctgttgatcgcttcagtaggaagccatgccgctcggactccggagcaatactggaaatcagctcttcccaactctcccatcccgagctcgctctctcagcttctcagcactgcaggcggaggcacgtcggtgaacgtcggcgggggcggcgtccatgtcgacgcggggcacggcaagcccggcggcacaaccgttgatgtaggcaagggtggcgtcggcgtgaacgtgaagcctggttacggcaagcccggcggcaccacggtcggcgtcgggaagggcggcgtgggagtcaacgtcaagcctggctatggcaagcccggaggcaccagcgtcggcgtcgggaaaggaggcgtgggcgtgaacgtgcagcctgggtacggcaagcccggcggcaccaccgtcggcgtcggtaagggcggcgtcggcgtgaacgtgcagccaggctacggcaagcccgggggcaccaccgtcggcgtcgggaagggcggcgtcggcgtcaacgtgaagccccggggcaagcctgtccacgtcaacgtcgcacctttcatctacaactacgccgcaacggagacgcagctgcacgacgaccccaacgtggcgctcttcttcttggagaaggacctccaccccgggaagacgatggccgtacatttcacggccaccaccgccggagagaagttcctccccaggagcgaggccgacgccatgccgttctcctccgagaaggtcccggagatcctcagccgcttctccgtgaagccgggctccgtcgaggcggcggagatggcgcagacgctgcgcgactgcgaggcgccgccggcgcagggcgagaggaaggcgtgcgccacgtcgctcgagtccatggtcgacttcgccacgtcgagcctcgggaccagccacgtgagggccgcgtcgaccgtggtcgggaaggaagggtcgccggagcaggagtacaccgtgacggcggtgaagcgcgcggcggccggcggcgaccaggaccagctcgtcgcctgccacgcggagccgtacgcgtacgccgtgttcgcgtgccacctgacgcgggcgacgcgggcgtacgcggtgtcgatggccggcagggacggcacgggcgtggaggccgtcgcggtgtgccacgccgacacggccgggtggaacccgaagcacgtcgcgttccaggtgctcaaggtgaagccaggcacggtgccggtctgccacttcctgccgcaggaccacgtcgtctggacacgcagcggctagctgatgatcggctgccaatcttggcgcctgatcgagttggttgcttatgctctagaatctagctaggctccatgcagatgctatactgtatggtgtcttactatcttacatatttgtatgcacgcaatttggttctttgttatttggatggtgttgccagcatcgccagcctgctagtagatgatacgggtgggcttgctgtttgatgtatagttttagtatgcgggtgcaataaacagacaagtatttacttatctctttatcagtgccatctagctccgttcgatcattcctaaggaaactcaatcaagcagggcaaagaccccaagactgaagatggtagtacagtgctctcacctaaattctaatggcaatgcaaacagtcaaatgtgtttgattt

SEQ ID NO: 115 - protein, 429 aa, Oryza sativa
MDRLLACLLGFLLIASVGSHAARTPEQYWKSALPNSPIPSSLSQLLSTAGGGTSVNVGGGGVHVDAGHGKPGGTTVDVGKGGVGVNVKPGYGKPGGTTVGVGKGGVGVNVKPGYGKPGGTSVGVGKGGVGVNVQPGYGKPGGTTVGVGKGGVGVNVQPGYGKPGGTTVGVGKGGVGVNVKPRGKPVHVNVAPFIYNYAATETQLHDDPNVALFFLEKDLHPGKTMAVHFTATTAGEKFLPRSEADAMPFSSEKVPEILSRFSVKPGSVEAAEMAQTLRDCEAPPAQGERKACATSLESMVDFATSSLGTSHVRAASTVVGKEGSPEQEYTVTAVKRAAAGGDQDQLVACHAEPYAYAVFACHLTRATRAYAVSMAGRDGTGVEAVAVCHADTAGWNPKHVAFQVLKVKPGTVPVCHFLPQDHVVWTRSG

SEQ ID NO: 116 - DNA, 1128 bp, Zea mays
atggagaggctccttgccggcctactactcggcttcctattattgatcgcgtcagtaggaagccatgcaactcgtgctccagatcagtactggaagtctgctcttcccgacactcccatgccgagctccctctcccaactcctcaacaccccagctggcaagggcggcgtcggtggaggcagcagcggcaagaagcccggcggcaccacggtgggagttgggaaagggggagtgggcgttaacgttaaccctaccaaacccggcggcgccggtacaaccgttggcgttggcaaaggtggcgtcggcgtcggcgtcaatcccgggtacggcaagccgggtggcaccacggtgggcgttggcaagggcagggttggcgtccacgtgaacccgggcaagaagcccgtccacgtccccgtcggccctttccagtacgagtacgccgcatcggagacgcagttgcacgacgaccccagcgtggcgctcttcttccgagaggaggacctgcagcccggtaagaagacgaccgtccagttcgccaacaccgcgatggccggcgccaagttcctcccgcgaagcgatgccgaggccatcccgttctcctccgagaaggtccccgagatcctcggccgcttctcggtggacccggactccgtggaggcggcggagatggcgcagacgctgcacgactgcgaggcgcccgcggccaggggcgagaggaaggcgtgcgccacgtcgctggaatccatggtggactttgccaccgccagcctcgggaccagccacgtgagggccgcgtcgacggtcgtggggagggagggctcgccgaggcaggagtacaccgtgacaggcgtgaagcgggcgggcggcgggcgcctggtggcctgccacgcggagccgtacgcgtacgccgtgttcgcgtgccacttgacgcagcagacgcgggcgtactcggtgtcgatgctgggcagggacggcacggccgtggacgctgtcgcggtgtgccacgccgacacgtccggctggaaccccaagcacgtcgcgttccaggtgctcagggtgaagcccggcacggtgccgatctgccacttcctgccgcaggaccacgtcgtctggacccgcggcggctga

SEQ ID NO: 117 - protein, 375 aa, Zea mays
MERLLAGLLLGFLLLIASVGSHATRAPDQYWKSALPDTPMPSSLSQLLNTPAGKGGVGGGSSGKKPGGTTVGVGKGGVGVNVNPTKPGGAGTTVGVGKGGVGVGVNPGYGKPGGTTVGVGKGRVGVHVNPGKKPVHVPVGPFQYEYAASETQLHDDPSVALFFREEDLQPGKKTTVQFANTAMAGAKFLPRSDAEAIPFSSEKVPEILGRFSVDPDSVEAAEMAQTLHDCEAPAARGERKACATSLESMVDFATASLGTSHVRAASTVVGREGSPRQEYTVTGVKRAGGGRLVACHAEPYAYAVFACHLTQQTRAYSVSMLGRDGTAVDAVAVCHADTSGWNPKHVAFQVLRVKPGTVPICHFLPQDHVVWTRGG

SEQ ID NO: 118 - DNA, 1197 bp, Oryza sativa
atgtggcatcctaaaagcgctctcaagctgccacgtggtgggaggagaggagatgaggacccacaaaaaaaacgaaatcctctcccacaacgtccgcatgtacgcatgcatgtggatgctttcctcccatgcttagcggcaggattaccaagtaatcagggttttacattaataaggttttttttctgttatttggatcgtctatctggagtaaacgatcttatgtgtgcgaccctatgtactttgctggatgagatctctatcttaatattgatgctgctcttgattcaactggagattagggtttcggcggcacaggggggaggaagccatgcagctatgtcccccgagcaatactggcgatccatcctccccgacagtacccctatgccgatctccatttcccaactccttggcgatggttacccttactcaccagctgttggattaccgaagcgtggagaccgtgttcagattaggtacggtccgaatatttacgggcttgcagcgtcgcagcagttcttcaaagacccaaccatgggactcttcttccttgagacaaacctccaaagcagcaaaagtattaaactgcacttcgccaacatgatggctggcaccaagtttctgccccgaggcgaggccgacgccgtcccattctcctccaaggatctccaggagatcctcgcgcgattcggggtgcggccgggctccgtggacgcgtcggtggtgaagaacacactgctggagtgcgagctaccggcgaacaaaggcgagaagaaggcttgcgccacatcactggagtcgatggtcgacttcgtagcatccagcctggggaccagagacatcaaggccgcctccaccttcctggtcggcaaggacggggacactccggctcaggagtacacggtcaccggcgcgcggcgcatggctgaaactgggcaactcatcgcttgccatcccgagtcgtacccatatgctgtgttcatgtgccacctcacagaggcgacgagggcgtacaaggcgtcgttggtcggcaaagacggtgcggcggtggaggcggtcgccgtatgccacaccgacacggcagagtggaacccaaagcacgctgccttccaggtgctcggcgtcaagcctgggacggtgccggtctgccacttcgtgcagcctgacgttgtcgtctggacccgccgtggctga

SEQ ID NO: 119 - protein, 398 aa, Oryza sativa
MWHPKSALKLPRGGRRGDEDPQKKRNPLPQRPHVRMHVDAFLPCLAAGLPSNQGFTLIRFFFCYLDRLSGVNDLMCATLCTLLDEISILILMLLLIQLEIRVSAAQGGGSHAAMSPEQYWRSILPDSTPMPISISQLLGDGYPYSPAVGLPKRGDRVQIRYGPNIYGLAASQQFFKDPTMGLFFLETNLQSSKSIKLHFANMMAGTKFLPRGEADAVPFSSKDLQEILARFGVRPGSVDASVVKNTLLECELPANKGEKKACATSLESMVDFVASSLGTRDIKAASTFLVGKDGDTPAQEYTVTGARRMAETGQLIACHPESYPYAVFMCHLTEATRAYKASLVGKDGAAVEAVAVCHTDTAEWNPKHAAFQVLGVKPGTVPVCHFVQPDVVVWTRRG

SEQ ID NO: 120 - DNA, 978 bp, Medicago trunactula
atggattttcatcttgttcacatcattacttttttcatgcttgtggtaggggcaactaatgctgtaatgttacctcctcaactttactggaagtccatgcttcccaactctccaatgccaaaagccatcactaatctgctacaccctgctggatattggagtgaagagaaaggaacttgggtggatgtaggcaagggtggtgtggatgttggagtcagaaagggctactatgaaggaggtggcactgatgtgaatgttggagttggacgttctccatttatttataattatgctgcaagtgagactcaattacatgataaaccaaatgtagcactcttctttctggaaaaggacctgcatcatggaacaaaactgaacttgcaattctctaagaccacttcaaatgcagccacattcttgccgcgccaagttgctaattcaatacccttttcatcaaacaagatggaatacataatcaacaagttaaacatcaagaaagggtcaaagggtgttcagattgtgaagaacaccatcagtgagtgtgaagagcaagggatcaaaggagaggaaaaggtttgcgtaacatcattggagtctatggttgatttcacgacttctaaacttggtaaaaatgttgaggctgtttcaacagaagtgaacaaagaaagtaatttacaacaatatacaatagcatctggagtgaagaagttgggtgagaagaacaaagctgttgtgtgtcacaaagagaattacccttatgcagtgttttactgtcacaaaacagatacaactaaagcttactctgtgcctttggagggtgctgatggaagcagagttaaagctattgctgtgtgtcacactgatacatcagaatggaacccaaaacacttggcatttcaagtactcaaagttcaacctgggactgttccagtttgtcacctcctacctgaggatcatgttgtttggattcgcaagtag

SEQ ID NO: 121 - protein, 325 aa, Medicago trunactula
MDFHLVHIITFFMLVVGATNAVMLPPQLYWKSMLPNSPMPKAITNLLHPAGYWSEEKGTWVDVGKGGVDVGVRKGYYEGGGTDVNVGVGRSPFIYNYAASETQLHDKPNVALFFLEKDLHHGTKLNLQFSKTTSNAATFLPRQVANSIPFSSNKMEYIINKLNIKKGSKGVQIVKNTISECEEQGIKGEEKVCVTSLESMVDFTTSKLGKNVEAVSTEVNKESNLQQYTIASGVKKLGEKNKAVVCHKENYPYAVFYCHKTDTTKAYSVPLEGADGSRVKAIAVCHTDTSEWNPKHLAFQVLKVQPGTVPVCHLLPEDHVVWIRK

SEQ ID NO: 122 - DNA, 1206 bp, Populus trichocarpa
atggagttccatcttacacgcattcttgctttcctttcttttgcacttgtggtaagccacgctgccttgccacctgaactttactggaactctgtgctgcctaacactcctatgccaaaatctgtcagagatcttctacacccagacttggtggaagacaaaagcacttctgttgctgtagggaagggtggtgtaaatgttgatgcaggaaaagggaagccagggggcactgctgttaatgtaggaaagggtggtgtgagtgttgatgcagggaaaggaaagcccggaggaaccaatgtaaatgcaggaaagggtggtgtgaatgttgatgctgggaaaggaaagccaggcagcggcacccatgtcagcgtcgggggcaaaggtgttggtgttgccgctggaaagccagggaagagaaccgatgttggtgttggcaaaggcggagtatctgtgagcaaagggcaccatggcaagcccgtaattgttggggtacgcccagggccaggcccgttcaactacatttatgctgcaactgagactcaactccatgatgacccaaatgtagccctttttttcttggagaaagacatgcatccaggcaaaattatgaacttgcaattcactgaaaacactaacacagcaactttcttaccacgtcaagtcgccgattcaatacccttttcatctgacaaattgccagaaatctacagtgagttttcagtgaaacctggatcaatggaagctgcggagatggagaatacaatcaaggaatgtgaaagccctggaattaaaggagaggagaaatactgcgcgacatcactagagtcaatgattgacttcagcacttccaaattaggaaagaatgttcaggcaatctccacagaagtggacaaccaaaccaagatgcagaagtatacaattaagaccggagtaaagaaggtggcaggagacaaatctgtagtgtgccacaagcagaactatgcatattccgtcttttactgccatgcaacgcaaaccactagggcttacacggttcccttggagggtgatgatggaacaaaggctaaagctgtagcagtgtgccacacagatacgtcagcatggaacccaaagcatttggctttccaggtgctcaacgttaagccaggaaccgtaccagtctgccatttccttcctcaggatcatgttgtgtggttttccaactag

SEQ ID NO: 123 - protein, 401 aa, Populus trichocarpa
MEFHLTRILAFLSFALVVSHAALPPELYWNSVLPNTPMPKSVRDLLHPDLVEDKSTSVAVGKGGVNVDAGKGKPGGTAVNVGKGGVSVDAGKGKPGGTNVNAGKGGVNVDAGKGKPGSGTHVSVGGKGVGVAAGKPGKRTDVGVGKGGVSVSKGHHGKPVIVGVRPGPGPFNYIYAATETQLHDDPNVALFFLEKDMHPGKIMNLQFTENTNTATFLPRQVADSIPFSSDKLPEIYSEFSVKPGSMEAAEMENTIKECESPGIKGEEKYCATSLESMIDFSTSKLGKNVQAISTEVDNQTKMQKYTIKTGVKKVAGDKSVVCHKQNYAYSVFYCHATQTTRAYTVPLEGDDGTKAKAVAVCHTDTSAWNPKHLAFQVLNVKPGTVPVCHFLPQDHVVWFSN

SEQ ID NO: 124 - DNA, 1198 bp, Vitis vinifera
atggagttttacctccttcccattctggcttttctctctctaactctaacagccggtgatgctgatctaccttctgaagtttactggagttctgtgcttccaaacaccccgatgccacaagctgtcaagaatagtctacgtccagacctgctggaagaccaaagcacccctgtagagatagggaaaggcactagtatgggtttcagcaaagaaggaggagctatgaacatgtatgctggagttaagccagcgaaagcagcgatgcccttctcataccattatgctgctacaaaggatcagctccatgcctaccctaatgtggccattttcttcttggagaaggacatgcatcccggcatgaagctgaccttgcacttcaccaagactacaaatgctactttcttacctcaccaagtagctaattcattacccttctcttcagacaagttggctgaaattctggaccagttgtccataaaaccagaatcagtagaagctgagacaatcaagaatacgattgaagagtgtgaggaccctggaattaaaggggaggaaaagtattgtgcaacctcattagaatccatgattgatttcagcacctcgaagctggggaataagggtgtcaaggccgtttcaacagaggcagaaaacaagtcccagatgaagtacagaattgcagctggtttggagaagatgggaggcgacttctctgtggtgtgccataaaatgaattacccatatgcagtgttttactgtcataagatccaggccacaagggcttatatggttcccttggtgggcagggatgggacaaaagcaaaagcagttgcagtgtgtcatgcaaatacaatggaatggaaccccaatcatttggcctttcaactgctcaaagtcaagccgggaactgctcccatctgccacttccttcctgaggaccatgtcgtctgggttgcaaagtagagatgggcaattaatgaataaataaataaactcatctgagttcttcggtaatgttatgaattggaatatcatcgtgaggggcacttgatgttaatttggaatttttatgcagtgtatatatgctagctgcaaccctcactctttgtactatctattaggtatgtaagcgtgccagatattgccttctcttagttaaatactaatgctacttattctggtgtgcttcgccaatttattc

SEQ ID NO: 125 - protein, 319 aa, Vitis vinifera
MEFYLLPILAFLSLTLTAGDADLPSEVYWSSVLPNTPMPQAVKNSLRPDLLEDQSTPVEIGKGTSMGFSKEGGAMNMYAGVKPAKAAMPFSYHYAATKDQLHAYPNVAIFFLEKDMHPGMKLTLHFTKTTNATFLPHQVANSLPFSSDKLAEILDQLSIKPESVEAETIKNTIEECEDPGIKGEEKYCATSLESMIDFSTSKLGNKGVKAVSTEAENKSQMKYRIAAGLEKMGGDFSVVCHKMNYPYAVFYCHKIQATRAYMVPLVGRDGTKAKAVAVCHANTMEWNPNHLAFQLLKVKPGTAPICHFLPEDHVVWVAK

SEQ ID NO: 126 - DNA, 1011 bp, Bruguiera gymnorhiza
atggagtctcgtatcccatatatcctaggtttgctcatgcttgcgctggtggcaagtggcgcggccttggcccctgaagcttattggaactctgttttgcctaacacgcccatgccaaaggctatcaaagatcttctacacccagatatgttggaggacaaaggcacttcagtggctgtaggaaagggcggtgtaaatgttgatgctggaaaaggaaagcctggtggtggcacccatgttggtgtgggaggaaaaggtgttggtgttgacgctggaaagcctggcggtggcggcaccaattttggctttgacagagctgtctcaaacatttatgctgcatctgaagatcagatccacgacaaccccaacttagctctctttttcttgcaaaaagacttgaaaccgggcaaatccatgaacttggatttccccgaaagctcaaacacggcaactttcttgcctcgccacgtcgcagattccataccattttcatcaaacaagttgcaagatgctttccgcgaattttcggtgaagcccggatctctggaagctgaaataatggagaatacagtcaaggaatgtgaaaatcctggaattgaaggagaagagaaatactgtgcaacttcactggagtcgatggttgactttagcacttccaaacttggaaaggacattcaggcaatctctacagaggttgagaagcaaacgggcaggcagaaatatacaatcgccggagtaaagaagatagcaggtgacaaatgcgtggtttgccacaagcagaattacccttatgctgtattctactgccattcaattcaatccacaagggcttacctggttcaattaaagggtgttgacagaacaaggcttcaagcagtagcaatctgccacacgaacacatcagcatggaacccaaaacatccggctttccaagtgctagcggtcaagcccggaactgtgcctatttgccatttccttccccagagccatgttgtttgggttcccaagtag

SEQ ID NO: 127 - protein, 336 aa, Bruguiera gymnorhiza
MESRIPYILGLLMLALVASGAALAPEAYWNSVLPNTPMPKAIKDLLHPDMLEDKGTSVAVGKGGVNVDAGKGKPGGGTHVGVGGKGVGVDAGKPGGGGTNFGFDRAVSNIYAASEDQIHDNPNLALFFLQKDLKPGKSMNLDFPESSNTATFLPRHVADSIPFSSNKLQDAFREFSVKPGSLEAEIMENTVKECENPGIEGEEKYCATSLESMVDFSTSKLGKDIQAISTEVEKQTGRQKYTIAGVKKIAGDKCVVCHKQNYPYAVFYCHSIQSTRAYLVQLKGVDRTRLQAVAICHTNTSAWNPKHPAFQVLAVKPGTVPICHFLPQSHVVWVPK

SEQ ID NO: 128 - DNA, 924 bp, Medicago trunactula
atgaagtttgcttacatatccatctttatatctctcagtcttgcactggtggcaacccatgctaccttaccacctgaattgtattggaagtccaaacttcccacaactcaaattccaaaagccatcacagatatccttcacccaatggatgatggaaaaatcagtgttgatggaaaaatcagtgttaatggaaaaacaaggatagtatatgatgcagctccaatttatttctatgaaaatgatgcaaatgaagcagaattacatgataatcgaaatttggctatgttcttattggaaaaggacttgcatcatggtacaaaattcaacatacaattcacaaagacctcagaccatggaccgacattcttgcctggtgacgttgcgaattccattcccttttcatcaaacaaattggaaaacatccttaactacttctccatcaagcaaggatcgacggaatctgaaattgtgaagaacacaataagtgaatgtgaagcatatggtatcaaaggagaggaaaagctttgtgtgacatcattggaatctatgattgatttcactactttgaagcttggaaacaatgttgacactgtttcaacagaagtaaatggagaaagtggtttacaacaatatgtaatagcaaacggagtgaagaaaatgggagagaacaatttggttgtgtgccacaaacggaattacccttatgcagttttttactgtcacaaaacagatgcaactaaagtttactctgtgcctttggaaggtgctgatggaagtagagttaaagctgttgctatttgccactctgatacttcacaatggagccttaaacatttggcttttcaagtgctcaaagttcaacaaggaacttttccagtttgccacatcctacaacagggtcaagttgtttggttttccaagtaa

SEQ ID NO: 129 - protein, 307 aa, Medicago trunactula
MKFAYISIFISLSLALVATHATLPPELYWKSKLPTTQIPKAITDILHPMDDGKISVDGKISVNGKTRIVYDAAPIYFYENDANEAELHDNRNLAMFLLEKDLHHGTKFNIQFTKTSDHGPTFLPGDVANSIPFSSNKLENILNYFSIKQGSTESEIVKNTISECEAYGIKGEEKLCVTSLESMIDFTTLKLGNNVDTVSTEVNGESGLQQYVIANGVKKMGENNLVVCHKRNYPYAVFYCHKTDATKVYSVPLEGADGSRVKAVAICHSDTSQWSLKHLAFQVLKVQQGTFPVCHILQQGQVVWFSK

SEQ ID NO: 130 - DNA, 1131 bp, Gossypium arboreum
atgaaggttctctccccaattcttgcttgcctagcgcttgctgtggtggcaagtcatgctgctctctcacccgagcaatattggagctataagctgccaaatactccaatgccaaaggctgtcaaagaaattctacatccagaactgatggaggagaaaagtacctctgtaaatgtaggaggtggtggtgtaaacgtcaacacaggaaaagggaagccagcgggtggcactcatgtgaacgttgggcgcaaaggagttggagtgaacacgggaaagccagggggtggcactcatgtgaatgttggaggcaaaggagttggggtgaacactggaaagccaggaggtggcacccatgtgaacgttggaggcaaaggtggaggagtatctgtacacaccggacacaagggaaagccagtaaatgttaatgtgagtccgtttctttaccaatatgcagccagtgaaactcaaatccatgacgatccgaatgtggctcttttctttctggaaaaggatttacaccccggggcaacaatgagcctgcatttcactgaaaatacagagaaatccgctttcttaccttatcaaactgcccaaaaaataccgttttcatctaacgagttgccagaaattttcaacaagttttcagtgaaacctggatcagtgaaggcagagatgatgaagaacacaattaaggagtgcgaacagccagcgattgaaggagaggaaaaatattgtgcaacctcactggagtcaatgattgactacagcatttccaaactagggaaagttgatcaggcagtctcaacagaagtggaaaaacaaaccccaacgcacaagtatacaataacagctggagtgcagaagatgacaaatgacaaagctgtagtgtgccacaagcagaattatgcatatgctgtcttctattgccataaatcagaaacaacaagggcttacatggttcctttagagggtgctgacggaacaaaagccaaagcagtagcagtctgtcacacagatacatcagcatggaacccaaagcatttggcttttcaagtcctaaaagttgagccaggaaccattcctgtctgccatttccttcctcgggatcacattgtttgggtccccaagtaa

SEQ ID NO: 131 - protein, 376 aa, Gossypium arboreum
MKVLSPILACLALAVVASHAALSPEQYWSYKLPNTPMPKAVKEILHPELMEEKSTSVNVGGGGVNVNTGKGKPAGGTHVNVGRKGVGVNTGKPGGGTHVNVGGKGVGVNTGKPGGGTHVNVGGKGGGVSVHTGHKGKPVNVNVSPFLYQYAASETQIHDDPNVALFFLEKDLHPGATMSLHFTENTEKSAFLPYQTAQKIPFSSNELPEIFNKFSVKPGSVKAEMMKNTIKECEQPAIEGEEKYCATSLESMIDYSISKLGKVDQAVSTEVEKQTPTHKYTITAGVQKMTNDKAVVCHKQNYAYAVFYCHKSETTRAYMVPLEGADGTKAKAVAVCHTDTSAWNPKHLAFQVLKVEPGTIPVCHFLPRDHIVWVPK

SEQ ID NO: 132 - DNA, 1008 bp, Gossypium arboreum
atgaaggttctctccccaattcttgcttgcctagcgcttgctgtggtggtaagccatgctgctctctcacctgagcaatattggagctataagctgccaaatactccaatgccaaaggctgtcaaagaaattctacatccagaactgatggaggagaaaagtacctctgtaaatgtaggaggtggtggtgtaaacgtcaatacaggaaaagggaagcctgggggtgacacccatgtgaacgttggaggcaaaggagttggagtgaacacgggaaagccagggggtggcactcatgtgaatgatccagacccttttaattacctatatgcagccagtgaaactcaaatccatgaggacccgaatgtggctcttttctttctggaaaaggatatgcaccccggggcgacaatgagcctgcatttcattgaaaatacagagaaatcagctttcttaccttatcaaactgccccaaaaaatacgttttcatctgacaagttgccagaaattttcaacaagttttcagtgaaacctggttcagtgaaggcagagatgatgaagaacacaattaaggagtgcgaacagccagcgattgaaggagaggaaaaatattgtgcaacctcactggagtcaatgattgactatagcatttccaaactagggaaagttgatcaggcagtctcaacagaagtggaaaaacaaaccccaatgcaaaagtatacaatagcagctggagtgcagaagatgacagatgacaaagctgtagtgtgccacaagcagaattatgcatatgctgtcttctattgccataaatcagaaacaacaagggcttacatggttcctttagagggtgctggcggaacaaaagccaaagcactagcagtctgccacacagatacatcagcatggaacccaaagcatttggcttttcaattcctaaaagttgaaccaggaaccattcctgtctgtcatttccttcctcgggatcacattgtttgggtccctaagtaa

SEQ ID NO: 133 - protein, 335 aa, Gossypium arboreum
MKVLSPILACLALAVVVSHAALSPEQYWSYKLPNTPMPKAVKEILHPELMEEKSTSVNVGGGGVNVNTGKGKPGGDTHVNVGGKGVGVNTGKPGGGTHVNDPDPFNYLYAASETQIHEDPNVALFFLEKDMHPGATMSLHFIENTEKSAFLPYQTAPKNTFSSDKLPEIFNKFSVKPGSVKAEMMKNTIKECEQPAIEGEEKYCATSLESMIDYSISKLGKVDQAVSTEVEKQTPMQKYTIAAGVQKMTDDKAVVCHKQNYAYAVFYCHKSETTRAYMVPLEGAGGTKAKALAVCHTDTSAWNPKHLAFQFLKVEPGTIPVCHFLPRDHIVWVPK

SEQ ID NO: 134 - DNA, 1008 bp, Gossypium hirsutum
atgaaggttctctccccaattcttgcttgcctagcgcttgctgtggtggtaagccatgctgctctctcacctgagcaatattggagctataagctgccaaatactccaatgccaaaggctgtcaaagaaattctacatccagaactgatggaggagaaaagcacctctgtaaatgtaggaggtggtggtgtaaacgtcaatacaggaaaagggaagcctgggggtgacacccatgtgaacgttggaggcaaaggagttggagtgaacacgggaaagccagggggtggcactcatgtgaatgttggagacccttttaattacctatatgcagccagtgaaactcaaatccatgaagacccgaatgtggctcttttctttctggaaaaggatatgcaccccggggcaacaatgagcctgcatttcactgaaaatacagagaaatcagctttcttaccttatcaaactgcccaaaaaataccgttttcatctgacaagttgccagaaattttcaacaagttttcagtgaaacctggatcactgaaggcagagatgatgaagaacacaattaaggagtgcgaacagccagcgattgaaggagaggaaaaatattgtgcaacctcactggagtcaatgattgactatagcatttccaaactagggaaagttgatcaggcagtctcaacagaagtggaaaaacaaaccccaatgcaaaagtatacaatagcagctggagtgcagaagatgacagatgacaaagctgtagtgtgccacaagcagaattatgcatatgctgtcttctattgccataaatcagaaacaacaagggcttacatggttcctttagagggtgctgacggaacaaaagccaaagcagtagcagtctgccacacagatacatcagcatggaaccctaagcatttggcttttcaagtcctaaaagttgaaccaggaaccattcctgtctgccatttccttcctcgggatcacattgtttgggtccctaagtaa

SEQ ID NO: 135 - protein, 335 aa, Gossypium hirsutum
MKVLSPILACLALAVVVSHAALSPEQYWSYKLPNTPMPKAVKEILHPELMEEKSTSVNVGGGGVNVNTGKGKPGGDTHVNVGGKGVGVNTGKPGGGTHVNVGDPFNYLYAASETQIHEDPNVALFFLEKDMHPGATMSLHFTENTEKSAFLPYQTAQKIPFSSDKLPEIFNKFSVKPGSLKAEMMKNTIKECEQPAIEGEEKYCATSLESMIDYSISKLGKVDQAVSTEVEKQTPMQKYTIAAGVQKMTDDKAVVCHKQNYAYAVFYCHKSETTRAYMVPLEGADGTKAKAVAVCHTDTSAWNPKHLAFQVLKVEPGTIPVCHFLPRDHIVWVPK

SEQ ID NO: 136 - DNA, 1008 bp, Gossypium hirsutum
atgaaggttctctccccaattcttgcttgcctagcgcttgctgtggtggtaagccatgctgttctctcacctgagcaatattggagctataagctgccaaatattccaatgccaaaggctgtcaaagaaattctacatccagaactgatggaggagaaaagtacctctgtaaatgtaggaggtggtggtgtaaacgtcaatacaggaaaagggaagcctgggggtgacacccatgtgaacgttggaggcaaaggagttggagtgaacacgggaaagccagggggtggcactcatgtgaatgatccagacccttttaattacctatatgcagccagtgaaactcaaatccatgaggacccgaatgtggctcttttctttctggaaaaggatatgcaccccggggcgacaatgagcctgcatttcattgaaaatacagagaaatcagctttcttaccttatcaaactgcccaaaaaataccgttttcatctgacaagttgccagaaattttcaacaagttttcagtgaaacctggatcagtgaaggcagagatgatgaagaacacaattaaggagtgcgaacagccagcgattgaaggagaggaaaaatattgtgcaacctcactggagtcaatgattgactatagcatttccaaactagggaaagttgatcaggcagtctcaacagaagtggaaaaacaaaccccaatgcaaaagtatacaatagcagctggagtgcagaagatgacagatgacaaagctgtagtgtgccacaagcagaattatgcatatgctgtcttctattgccataaatcagaaacaacaagggcttacatggttcctttagagggtgctggcggaacaaaagcccaagcactagcagtctgccacacagatacatcagcatggaacccaaagcatttggcttttcaattcctaaaagttgaaccaggaaccattcctgtctgtcatttccttcctcgggatcacattgtttgggtccctaagtaa

SEQ ID NO: 137 - protein, 335 aa, Gossypium hirsutum
MKVLSPILACLALAVVVSHAVLSPEQYWSYKLPNIPMPKAVKEILHPELMEEKSTSVNVGGGGVNVNTGKGKPGGDTHVNVGGKGVGVNTGKPGGGTHVNDPDPFNYLYAASETQIHEDPNVALFFLEKDMHPGATMSLHFIENTEKSAFLPYQTAQKIPFSSDKLPEIFNKFSVKPGSVKAEMMKNTIKECEQPAIEGEEKYCATSLESMIDYSISKLGKVDQAVSTEVEKQTPMQKYTIAAGVQKMTDDKAVVCHKQNYAYAVFYCHKSETTRAYMVPLEGAGGTKAQALAVCHTDTSAWNPKHLAFQFLKVEPGTIPVCHFLPRDHIVWVPK

SEQ ID NO: 138 - DNA, 1104 bp, Glycine max
atggtgtttcctctcctatctatctttgctttactcaatcttgcagtggtggcaacccatgcagaaaccttgccccctgaagtttactggaagtcgaagcttcccaccactccaatgccgaaagccattacagatatccttcacccagatttggcagaagacaaaagcacctctgtggccgtaggaaaggggggcgtaaacgttaacgcagggaaaacaaagccaggaggcacatcagtgaacgtaggaaaaggaggagtgaacgtgaacacagggaaaggaaagcccaacaaaggcacatcagtgaacgtaggcaaaggtggagtgaacgtaaacacaggaccaaagaagggtaagccagtgcacgttggagtgggcccacattctccatttgattacaattacgcagccagcgaaacccagtggcacgatgaccccaacgtggcactcttcttcttggaaaaggacttgcactacggaacaaagttgaaccttcacttcactcgctacttcacctcaagtgttgatgcctcgttcttgcctcgatcagttgctgattccatacccttttcatcaaacaaggtgaatgaagtgttaaacaagttctccatcaaggaagggtcagatgaggctcaaactgtgaagaacaccatcagtgagtgtgaagtgcctggcattaagggagaggaaaagcgttgcgtgacttcacttgagtccatggttgatttcgccactaccaagctcgggagcaaggatgttgatgctgtttccacagaagtgacaaaaaaagataatgagttacaacagtatacaatggcaccaggggttaagaggttgggtgaggacaaggctagtgttgtgtgtcacaaggagaattacccttatgcagtgttttattgccacaaatcagaaaacacaaaagcctattctgtcccattggagggtgctgatggaagcagggtcaaagcagttgcagtgtgccatactgacacatcaaagtggaatcccaagcatttggcgtttcaagtgcttaaggttcatccaggaactgttcctatctgccacttcctgcctcaggatcatgttgtctttgttcccaagtag

SEQ ID NO: 139 - protein, 367 aa, Glycine max
MVFPLLSIFALLNLAVVATHAETLPPEVYWKSKLPTTPMPKAITDILHPDLAEDKSTSVAVGKGGVNVNAGKTKPGGTSVNVGKGGVNVNTGKGKPNKGTSVNVGKGGVNVNTGPKKGKPVHVGVGPHSPFDYNYAASETQWHDDPNVALFFLEKDLHYGTKLNLHFTRYFTSSVDASFLPRSVADSIPFSSNKVNEVLNKFSIKEGSDEAQTVKNTISECEVPGIKGEEKRCVTSLESMVDFATTKLGSKDVDAVSTEVTKKDNELQQYTMAPGVKRLGEDKASVVCHKENYPYAVFYCHKSENTKAYSVPLEGADGSRVKAVAVCHTDTSKWNPKHLAFQVLKVHPGTVPICHFLPQDHVVFVPK

SEQ ID NO: 140 - protein, 21 aa, Artificial sequence
  motif 9
  VARIANT (1)..(1): / replace = "Glu"
  VARIANT (2)..(2): / replace = "Lys"
  VARIANT (3)..(3): / replace = "Lys"
  VARIANT (13)..(13): / replace = "Ile"
  VARIANT (14)..(14): / replace = "Glu"
  VARIANT (15)..(15): / replace = "Phe"
  VARIANT (16)..(16): / replace = "Val" / replace = "Ala"
  VARIANT (17)..(17): / replace = "Ala"
  VARIANT (19)..(19): / replace = "Ser"
HEHYCATSLESMVDLSTSKLG

SEQ ID NO: 141 - protein, 21 aa, Artificial sequence
  motif 10
  VARIANT (2)..(2): / replace = "Ala"
  VARIANT (5)..(5): / replace = "Lys"
  VARIANT (6)..(6): / replace = "Glu" / replace = "Met"
  VARIANT (7)..(7): / replace = "Pro"
  VARIANT (9)..(9): / replace = "Pro"
  VARIANT (14)..(14): / replace = "Gly"
  VARIANT (15)..(15): / replace = "Cys"
  VARIANT (17)..(17): / replace = "Gly" / replace = "Thr"
  VARIANT (18)..(18): / replace = "Ile" / replace = "Ser"
  VARIANT (19)..(19): / replace = "Glu"
  VARIANT (20)..(20): / replace = "Gly" / replace = "Thr"
  VARIANT (21)..(21): / replace = "Thr"
VVCHRQNYAYAVFYVHKTKAA

SEQ ID NO: 142 - protein, 29 aa, Artificial sequence
  motif 11
  VARIANT (1)..(1): / replace = "Pro"
  VARIANT (2)..(2): / replace = "Lys"
  VARIANT (3)..(3): / replace = "His"
  VARIANT (4)..(4): / replace = "Leu"
  VARIANT (6)..(6): / replace = "Phe"
  VARIANT (7)..(7): / replace = "Lys"
  VARIANT (8)..(8): / replace = "Val"
  VARIANT (10)..(10): / replace = "Gly"
  VARIANT (12)..(12): / replace = "Lys"
  VARIANT (15)..(15): / replace = "Lys" / replace = "Ser"
  VARIANT (17)..(17): / replace = "Ala"
  VARIANT (26)..(26): / replace = "His"
  VARIANT (27)..(27): / replace = "Met" / replace = "Ile"
  VARIANT (28)..(28): / replace = "Leu"
AVAEAYQRLKVAPGTVPVCHFLPQDDVVW

SEQ ID NO: 143 - protein, 29 aa, Artificial sequence
  motif 12
  VARIANT (1)..(1): / replace = "Leu"
  VARIANT (5)..(5): / replace = "Gln"
  VARIANT (6)..(6): / replace = "Arg"
  VARIANT (10)..(10): / replace = "Val"
  VARIANT (13)..(13): / replace = "Ala"
  VARIANT (15)..(15): / replace = "Asp" / replace = "Asn"
  VARIANT (21)..(21): / replace = "Phe"
  VARIANT (22)..(22): / replace = "Ser"
  VARIANT (23)..(23): / replace = "Gln" / replace = "Arg"
  VARIANT (24)..(24): / replace = "Leu"
  VARIANT (26)..(26): / replace = "Ile"
  VARIANT (27)..(27): / replace = "Lys"
  VARIANT (28)..(28): / replace = "Ala"
FLPRGVADSIPFSSEKLPEILNKFSVPPG

SEQ ID NO: 144 - protein, 32 aa, Artificial sequence
  motif 13
  VARIANT (1)..(1): / replace = "Leu"
  VARIANT (2)..(2): / replace = "Ser" / replace = "Thr"
  VARIANT (3)..(3): / replace = "Pro"
  VARIANT (5)..(5): / replace = "Gln"
  VARIANT (8)..(8): / replace = "Ser"
  VARIANT (9)..(9): / replace = "Ser"
  VARIANT (10)..(10): / replace = "Lys"
  VARIANT (13)..(13): / replace = "Thr"
  VARIANT (14)..(14): / replace = "Ser"
  VARIANT (16)..(16): / replace = "Ile"
  VARIANT (18)..(18): / replace = "Gly"
  VARIANT (19)..(19): / replace = "Ser"
  VARIANT (20)..(20): / replace = "Val"
  VARIANT (21)..(21): / replace = "Arg"
  VARIANT (23)..(23): / replace = "Ile"
  VARIANT (24)..(24): / replace = "Leu"
  VARIANT (25)..(25): / replace = "His"
  VARIANT (27)..(27): / replace = "Ala"
  VARIANT (28)..(28): / replace = "Leu"
  VARIANT (30)..(30): / replace = "Glu"
  VARIANT (31)..(31): / replace = "Glu"
  VARIANT (32)..(32): / replace = "Ser"
SPAEMYWKIALPNTPMPKAIKDLISPDSSAAK

SEQ ID NO: 145 - protein, 29 aa, Artificial sequence
  motif 14
  VARIANT (1)..(1): / replace = "Glu"
  VARIANT (2)..(2): / replace = "Thr"
  VARIANT (3)..(3): / replace = "Gln"
  VARIANT (4)..(4): / replace = "Asp" / replace = "Ile"
  VARIANT (5)..(5): / replace = "His"
  VARIANT (6)..(6): / replace = "Glu"
  VARIANT (8)..(8): / replace = "Pro"
  VARIANT (9)..(9): / replace = "Val" / replace = "Thr"
  VARIANT (10)..(10): / replace = "Val"
  VARIANT (11)..(11): / replace = "Ala"
  VARIANT (12)..(12): / replace = "Leu"
  VARIANT (17)..(17): / replace = "Glu"
  VARIANT (19)..(19): / replace = "Met"
  VARIANT (20)..(20): / replace = "Phe" / replace = "Arg"
  VARIANT (23)..(23): / replace = "Ser" / replace = "Ala"
  VARIANT (24)..(24): / replace = "Thr"
  VARIANT (26)..(26): / replace = "Thr"
ASKLKDDTNGSVFFLEKDLHPGKKMNLHF

SEQ ID NO: 146 - protein, 15 aa, Artificial sequence
  motif 15
  VARIANT (4)..(4): / replace = "Met" / replace = "Lys"
  VARIANT (5)..(5): / replace = "Val"
  VARIANT (6)..(6): / replace = "Glu"
  VARIANT (8)..(8): / replace = "Leu"
  VARIANT (10)..(10): / replace = "Val"
  VARIANT (13)..(13): / replace = "Gly" / replace = "Ala"
  VARIANT (15)..(15): / replace = "Val"
DGTRAKAVAACHTDT

SEQ ID NO: 147 - protein, 15 aa, Artificial sequence
  motif 16
  VARIANT (2)..(2): / replace = "Val"
  VARIANT (3)..(3): / replace = "Thr" / replace = "Lys"
  VARIANT (5)..(5): / replace = "Glu"
  VARIANT (6)..(6): / replace = "Met"
  VARIANT (7)..(7): / replace = "Val"
  VARIANT (8)..(8): / replace = "Lys"
  VARIANT (9)..(9): / replace = "Asn"
  VARIANT (10)..(10): / replace = "Thr"
  VARIANT (11)..(11): / replace = "Leu"
  VARIANT (12)..(12): / replace = "Lys"
  VARIANT (13)..(13): / replace = "Glu"
SPEADAMRSLIAVCE

SEQ ID NO: 148 - protein, 15 aa, Artificial sequence
  motif 17
  VARIANT (1)..(1): / replace = "Gly"
  VARIANT (2)..(2): / replace = "Gln"
  VARIANT (3)..(3): / replace = "Ser"
  VARIANT (5)..(5): / replace = "Arg"
  VARIANT (7)..(7): / replace = "Lys"
  VARIANT (9)..(9): / replace = "Thr"
  VARIANT (10)..(10): / replace = "Val"
  VARIANT (11)..(11): / replace = "Glu" / replace = "Thr"
  VARIANT (13)..(13): / replace = "Val" / replace = "Ala"
  VARIANT (14)..(14): / replace = "Val"
  VARIANT (15)..(15): / replace = "Pro" / replace = "Arg"
KPTPMQAYRIAAGRK

SEQ ID NO: 149 - protein, 8 aa, Artificial sequence
  motif 18
  VARIANT (3)..(3): / replace = "Thr"
  VARIANT (5)..(5): / replace = "Pro"
  VARIANT (7)..(7): / replace = "Ala"
AYMVTLEG

SEQ ID NO: 150 - protein, 33 aa, Artificial sequence
  motif 19
  VARIANT (1)..(1): / replace = "Gly"
  VARIANT (2)..(2): / replace = "Glu"
  VARIANT (3)..(3): / replace = "Ala"
  VARIANT (4)..(4): / replace = "Lys"
  VARIANT (5)..(5): / replace = "Tyr"
  VARIANT (15)..(15): / replace = "Asp"
  VARIANT (16)..(16): / replace = "Phe"
  VARIANT (17)..(17): / replace = "Val"
  VARIANT (18)..(18): / replace = "Thr"
  VARIANT (24)..(24): / replace = "Ser"
  VARIANT (25)..(25): / replace = "His"
  VARIANT (26)..(26): / replace = "Ile"
  VARIANT (27)..(27): / replace = "His"
  VARIANT (29)..(29): / replace = "Ala"
  VARIANT (32)..(32): / replace = "Val"
KHKHACATSLESMVELAASSLGTRDVRAVSTEV

SEQ ID NO: 151 - protein, 29 aa, Artificial sequence
  motif 20
  VARIANT (1)..(1): / replace = "Ala"
  VARIANT (2)..(2): / replace = "Val"
  VARIANT (4)..(4): / replace = "Tyr"
  VARIANT (5)..(5): / replace = "Gln"
  VARIANT (6)..(6): / replace = "Arg"
  VARIANT (8)..(8): / replace = "Lys"
  VARIANT (10)..(10): / replace = "Ala"
  VARIANT (13)..(13): / replace = "Lys" / replace = "Ser"
  VARIANT (15)..(15): / replace = "Pro"
  VARIANT (20)..(20): / replace = "Met"
  VARIANT (24)..(24): / replace = "Asp"
  VARIANT (25)..(25): / replace = "Met"
  VARIANT (26)..(26): / replace = "Leu"
  VARIANT (28)..(28): / replace = "Thr"
  VARIANT (29)..(29): / replace = "Ser"
HEAFKVLGVKPGTVAVCHFLPQDHVVWVR

SEQ ID NO: 152 - protein, 29 aa, Artificial sequence
  motif 21
  VARIANT (1)..(1): / replace = "Lys"
  VARIANT (2)..(2): / replace = "Leu"
  VARIANT (7)..(7): / replace = "Glu"
  VARIANT (9)..(9): / replace = "Glu"
  VARIANT (10)..(10): / replace = "Ala"
  VARIANT (11)..(11): / replace = "Ile"
  VARIANT (14)..(14): / replace = "Ser"
  VARIANT (19)..(19): / replace = "Ser"
  VARIANT (24)..(24): / replace = "Arg"
  VARIANT (25)..(25): / replace = "Leu"
  VARIANT (26)..(26): / replace = "Gly"
  VARIANT (27)..(27): / replace = "Ile"
  VARIANT (29)..(29): / replace = "Pro"
AFLPRGRADSVPFASEKLPEILSQFSVPA

SEQ ID NO: 153 - protein, 29 aa, Artificial sequence
  motif 22
  VARIANT (1)..(1): / replace = "His"
  VARIANT (10)..(10): / replace = "Leu"
  VARIANT (13)..(13): / replace = "Leu"
  VARIANT (14)..(14): / replace = "Val"
  VARIANT (23)..(23): / replace = "Ile"
  VARIANT (24)..(24): / replace = "Arg"
KYCATSLESMVEFAASSLGTRDVHAVSTE

SEQ ID NO: 154 - protein, 29 aa, Artificial sequence
  motif 23
  VARIANT (1)..(1): / replace = "Ala"
  VARIANT (5)..(5): / replace = "Ser"
  VARIANT (7)..(7): / replace = "Pro"
  VARIANT (13)..(13): / replace = "Thr"
  VARIANT (16)..(16): / replace = "Arg" / replace = "Asp"
  VARIANT (18)..(18): / replace = "Pro"
  VARIANT (20)..(20): / replace = "Pro"
  VARIANT (24)..(24): / replace = "Tyr"
  VARIANT (26)..(26): / replace = "Cys"
  VARIANT (28)..(28): / replace = "Gly"
  VARIANT (29)..(29): / replace = "Thr"
VRPVPVSGGDMVACHGMAYAYAVFGVHTI

SEQ ID NO: 155 - protein, 29 aa, Artificial sequence
  motif 24
  VARIANT (5)..(5): / replace = "Thr"
  VARIANT (7)..(7): / replace = "Asn"
  VARIANT (16)..(16): / replace = "Arg"
  VARIANT (21)..(21): / replace = "Ile" / replace = "Leu"
  VARIANT (26)..(26): / replace = "Pro"
  VARIANT (27)..(27): / replace = "Pro"
KEDTVGSVFFLEKDLFPGSKMTLHFTRAT

SEQ ID NO: 156 - DNA, 2194 bp, Oryza sativa; identical to SEQ ID NO: 91

SEQ ID NO: 157 - DNA, 56 bp, Artificial sequence
  primer: prm13652
ggggacaagtttgtacaaaaaagcaggcttaaacaatggctaggtctctcgctgct

SEQ ID NO: 158 - DNA, 50 bp, Artificial sequence
  primer: prm13653
ggggaccactttgtacaagaaagctgggtcgcaggtagctgcttcattca

SEQ ID NO: 159 - DNA, 549 bp, Medicago truncatula
atggacggtggaagaggaaaaggagagagaaagagaaacggtggtggtgttggtgttgatggagagagaagatacaaaggaattcgtatgagaaagtggggaaaatgggtagctgaaattcgagaaccaaacaaacgttctcgaatttggttaggttcctattctacccctatcgccgccgcaagagcttacgacaccgccgttttctacctccggggaccatcagctcgtctcaatttcccagagctactcaacggtgaaaacaacgcggttgttggtggtggtgatatgtcggcggctactattcgaaagaaagctactgaagttggtgctagagttgatgctcttcaagcagatgttaatcatcatagtcatagccatagtcataatcataatcatcatcaccttcagcataaccggaaccagcatcatcgtgttatgccggttccggagttgcttgaaggtgatggttctggtgattttgctgagagagttgatttgaataagattcctgaaccagagagttctgatgagtgggatgttaattga

SEQ ID NO: 160 - protein, 182 aa, Medicago truncatula
MDGGRGKGERKRNGGGVGVDGERRYKGIRMRKWGKWVAEIREPNKRSRIWLGSYSTPIAAARAYDTAVFYLRGPSARLNFPELLNGENNAVVGGGDMSAATIRKKATEVGARVDALQADVNHHSHSHSHNHNHHHLQHNRNQHHRVMPVPELLEGDGSGDFAERVDLNKIPEPESSDEWDVN

SEQ ID NO: 161 - DNA, 519 bp, Medicago truncatula
atggtacagcaaagcgaatcaactaggaggatcatggaagaagaaagagattgttgttcaacaataataagaaacatagaaagcaacaacaaacctcaagagaaacacaacaaacaacaactagagaaaccatacagaggaataaggaagagaaagtggggtaagtgggtagcagaaataagagaaccaaataaaagatcaagaatatggttaggttcttacatcactccggtagctgctgctcgtgcctacgacaccgccgtattctatttaagaggtcctacggctcgtcttaatttccccgaattattgctcgaagacgacgaagaaaacaaggacggttctattcagcaaggtaacatgtctgctgatttaatacgcaaaaaagctaccaaagtcggtgctagagttgatgctcttcaagcggctcttcaagcttcttctcgttctgattccgatcaattcaacgctgatgtgaaacctgatttgaacaagtttccagaacctgaagattattaa

SEQ ID NO: 162 - protein, 172 aa, Medicago truncatula
MVQQSESTRRIMEEERDCCSTIIRNIESNNKPQEKHNKQQLEKPYRGIRKRKWGKWVAEIREPNKRSRIWLGSYITPVAAARAYDTAVFYLRGPTARLNFPELLLEDDEENKDGSIQQGNMSADLIRKKATKVGARVDALQAALQASSRSDSDQFNADVKPDLNKFPEPEDY

SEQ ID NO: 163 - DNA, 453 bp, Arabidopsis thaliana
atggtgattcaatacaaacgaaaacaagagtttcctatggtgaaagaaggaatggtcatgaccgagaagccaaagaggaatctcataagctctaatgagaagcgatacaaaggaataaggatgaggaagtggggcaagtgggtggctgagataagagagcctaataaacgatcacggatctggcttggttcatacaaaaccgccgttgccgcggcacgggcctacgataccgctgtgttttacttacgtggtccttcggcgagactcaatttccctgaagaggtctttaaggatggaaacggcggtgaaggcttaggaggagatatgtctccgacgttgatacggaagaaggcggctgaggtgggagctagagtcgacgcagagttgcggttagagaataggatggttgagaacttagacatgaataagttgccggaggcatatggattgtaa

SEQ ID NO: 164 - protein, 150 aa, Arabidopsis thaliana
MVIQYKRKQEFPMVKEGMVMTEKPKRNLISSNEKRYKGIRMRKWGKWVAEIREPNKRSRIWLGSYKTAVAAARAYDTAVFYLRGPSARLNFPEEVFKDGNGGEGLGGDMSPTLIRKKAAEVGARVDAELRLENRMVENLDMNKLPEAYGL

SEQ ID NO: 165 - DNA, 720 bp, Triticum aestivum
atgcagcagggcgagtaccgctcgtcgtcttccagcgagggctccgcggggtcggcgtcggctgcggcggcggcgatggcgcctctggcggctgcggtcgcggcggtggcggccaaggaggagcacaacgtgacggtggccgtggcgccgcccatgcccatggcgatggcgatgccgctgcagcagcagcagccgcggaagcagtaccgcggcgtgcgcatgcgcaagtggggcaagtgggtggcggagatccgcgagccgcacaagcggacgcgcatctggctggggtcctacgccacccccgtcgccgccgcgcgcgcctacgacacggccgtcttctacctgcgcggcaggtcggcgcgcctcaacttccccgacgagatctccgcgctggcgctgtcgtcgcccgaggccgccgccgaggccggaggggaggagccgggcgacggcggcggcgcgctgtcggccgcgtcgatccggaagaaggccatcgaggtcgggtcccgcgtggacgcgctccagaccggcatgaccaccatggtcgccgcgcccgcgcaccaccgggagcggcagcggctccaccaacaccaccaccacgcggagccgcacgctgaggagctgcaccgccacgtgaagcagcagcggacggcgtggaacgggcgcgccaagaacccggatctcaaccaggcgccgagcccggacacctccgacgccgagtga

SEQ ID NO: 166 - protein, 239 aa, Triticum aestivum
MQQGEYRSSSSSEGSAGSASAAAAAMAPLAAAVAAVAAKEEHNVTVAVAPPMPMAMAMPLQQQQPRKQYRGVRMRKWGKWVAEIREPHKRTRIWLGSYATPVAAARAYDTAVFYLRGRSARLNFPDEISALALSSPEAAAEAGGEEPGDGGGALSAASIRKKAIEVGSRVDALQTGMTTMVAAPAHHRERQRLHQHHHHAEPHAEELHRHVKQQRTAWNGRAKNPDLNQAPSPDTSDAE

SEQ ID NO: 167 - DNA, 732 bp, Triticum aestivum
atgcagcagggcgagtaccgctcgtcgtcttccagcgagggctccgcggggtcggctgctgcggctgcggcggccgcggccatggcgcccctggcggctgcggccgcggcggtggcggccaaggaggagcacaacgtgacggtggccgtggcgccgcccatgcccatggcgatggcgatgccgctgcagcagcagcagccgcggaagcagtaccgcggcgtgcgcatgcgcaagtggggcaagtgggtggcggagatccgcgagccgcacaagcgcacgcgcatctggctgggctcctacgccacccccgtcgccgccgcgcgcgcctacgacacggccgtcttctacctgcgcggccggtcggcgcgcctcaacttccccgacgagatctccgcgctggcgctgtcgtcgcccgaggccgccgaggccggcggaggggaggagccgggcggcggcggcggcgcgctgtcggccgcgtcgatccggaagaaggccatcgaggtcgggtcccgcgtggacgcgctgcagaccggcatgaccaccatggtcgccgcgcccgcgcaccaccgcgagcggcagcggctccaccaccaccaccaccacgcggagccgcacggcgaggagctgcaccgccacgtgaagcagcagcggacggcgtggaacgggcgcgccaagaacccggatctcaaccaggcgccgagcccggacacctccgacgccgaggccgagtga

SEQ ID NO: 168 - protein, 243 aa, Triticum aestivum
MQQGEYRSSSSSEGSAGSAAAAAAAAAMAPLAAAAAAVAAKEEHNVTVAVAPPMPMAMAMPLQQQQPRKQYRGVRMRKWGKWVAEIREPHKRTRIWLGSYATPVAAARAYDTAVFYLRGRSARLNFPDEISALALSSPEAAEAGGGEEPGGGGGALSAASIRKKAIEVGSRVDALQTGMTTMVAAPAHHRERQRLHHHHHHAEPHGEELHRHVKQQRTAWNGRAKNPDLNQAPSPDTSDAEAE

SEQ ID NO: 169 - DNA, 702 bp, Oryza sativum
atgcagggcgagtaccaccgctcctccagcgaggactcggctgcttctgctgctgctgctgcggcggcggcggctgcggctatggctcctctcgccgcggctgcggcggcggttgctgccaaggaggagcaggcggcggcggcggcggtgctgccgctgcagcagcagcagccgaggcggcagtaccgtggcgtgcggatgcggaagtggggcaagtgggtggcggagatccgggagccgcacaagcggacgcgcatctggctggggtcgtacgcgacgcccgtggcggcggcgcgcgcctacgacacggcggtgttctacctccgcgggcggtcggcgcggctcaacttccccgaggagatctcctcgctggcgtcgctgtccgagggcggcggcgcgagcgagccccgcgagcccgacggcggcacgctgtccgcggcctcgatccggaagaaggccatcgaggtcggctcccgcgtcgacgcgctccagaccggcatgatggtcgcgccgacgacccaccaccgcgagcggcagaagcaccaccaccaccaccaccaccaccacccgcacctgcagccgcacggcgaggagcaacaccaccaccacgagcagaagcaccagcggacggcgtggagcggccgcgccaagaacccggatctcaaccaggcgccaagcccggagaactccgacgccgagtag

SEQ ID NO: 170 - protein, 233 aa, Oryza sativum
MQGEYHRSSSEDSAASAAAAAAAAAAAMAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 171 - DNA, 450 bp, Solanum lycopersicum
atgatggaaggagagaagagaaaacagaggcaacaccagcaagataagccatacagaggaatacggatgaggaagtggggtaaatgggtagctgaaattcgagaaccaaacaaacgctctcgaatttggcttggttcttattcttcccctgttgctgctgctcgtgcttacgataccgctgtattttacttgcgaggtccttcagctaggcttaatttccctgaatgtatagtggatgaccatgaaattcacgatctatcagctgcttctattaaaaagaaagctactgaggtaggtgctcgagttgatgctctgcaaactgcgattcacaattctactgttaattctgttgaatcaaactgtaattcgaattctaaatctacaaggatgatgatgaagcctgatttgaatgaatatcctagcccggaaagttgcgacgaagataactga

SEQ ID NO: 172 - protein, 149 aa, Solanum lycopersicum
MMEGEKRKQRQHQQDKPYRGIRMRKWGKWVAEIREPNKRSRIWLGSYSSPVAAARAYDTAVFYLRGPSARLNFPECIVDDHEIHDLSAASIKKKATEVGARVDALQTAIHNSTVNSVESNCNSNSKSTRMMMKPDLNEYPSPESCDEDN

SEQ ID NO: 173 - DNA, 489 bp, Brassica napus
atgctacaacacggagccgccgccatggaggccggagtagcagcagctgacatggccggcgtaaggaagagagaaagaccatacaaagggataaggatgagaaaatggggaaaatgggtggcggagattcgggagcccaacaaacgttcaaggctatggctcggctcttactctaccccagaggcggcggcgcgtgcatacgacacggcggttttctacctgagaggacctaccgcaacgctcaattttccggagcttataccgagcatcgagaaatcctcagtcgaggacatgtcggcggcagcgatcaggagaaaggcaacggaggtcggagctgaagtagacgcgtacgggatggcggtgatgaacagcaaacggcgccgcgtttttggtcagaagtgtgactatgttggcgggttattggagcgggttgacttgaacaagttaccttacccggaaaatcaggataatgatgtggtgggaaaataa

SEQ ID NO: 174 - protein, 162 aa, Brassica napus
MLQHGAAAMEAGVAAADMAGVRKRERPYKGIRMRKWGKWVAEIREPNKRSRLWLGSYSTPEAAARAYDTAVFYLRGPTATLNFPELIPSIEKSSVEDMSAAAIRRKATEVGAEVDAYGMAVMNSKRRRVFGQKCDYVGGLLERVDLNKLPYPENQDNDVVGK

SEQ ID NO: 175 - DNA, 462 bp, Helianthus annuus
atgggtgcacaacaccaccacaccacccaaaactcatcaacccgaaaaccccaaaatacgaaaccttaccgaggaattcgcatgcgaaagtggggcaaatgggttgcggagattcgtgagccgaacaagcgctcacgaatctggctgggttcatactcctcgcctgtggcggcggcgcgggcttacgacacggccgtgttttatttacgaggcccgtcggctcggcttaattttccggataaaattggggatgatgggtgcgggttgtgtgatttatctgcggcggatatacggaagaaggcgaccgaggttggagcgaaggtggacgcgctgcagaacgagggcgcgggcgcatgtcgaaagatatgtgagactgaaagctattcgggtcgggtttgtttgaacacggatttgaatgagtacccgagtccggaatcttcagatgagaatgatgagaattaa

SEQ ID NO: 176 - protein, 153 aa, Helianthus annuus
MGAQHHHTTQNSSTRKPQNTKPYRGIRMRKWGKWVAEIREPNKRSRIWLGSYSSPVAAARAYDTAVFYLRGPSARLNFPDKIGDDGCGLCDLSAADIRKKATEVGAKVDALQNEGAGACRKICETESYSGRVCLNTDLNEYPSPESSDENDEN

SEQ ID NO: 177 - DNA, 747 bp, Oryza sativum
atgtttgtaaggtttatagtctgctatttacctgctctaatcccccatctacccactgcgccacgcacgcacttaatcccctctatttatagaccccaccactcatttccccaggagaaaaagccgaagccaagacacgcaggtgtcgcctcgcctcgcctcgccctcgcgccgctgcggaattccgcgaggatggataggagggaggccaccgtcttcttgcccccgccgccgccaccgcagccgacgcagccgcagcagcagcctgcggcggcggcggtgagggctccggtaggcgggaggggtgggggaggagggaggcagtatcgcggggtgcggatgcggaagtgggggaagtgggtggcggagatccgcgagccgaacaagcggtcgcggatctggctcggctcctactccaccgccgtcgccgccgcgcgggcctacgacaccgccgtgttctacctccgcggccgctccgcgcgcctcaacttccccgaccagctcgacggcgcgggtggtggtggcgcgggcgccggcggcgccgaggaccacagggagctcaccgccgccgtcatccgcaagaaggccgccgaggtcggcgcccgcgtcgacgcgcagcactccgtcgtcggcgccgcggcgcccgtgccgctccagccgccgcagcccccgccgccccagcgccgccggaccaagaaccccgacctcaaccgggagcccaccccggacacctccgacgacgagtag

SEQ ID NO: 178 - protein, 248 aa, Oryza sativum
MFVRFIVCYLPALIPHLPTAPRTHLIPSIYRPHHSFPQEKKPKPRHAGVASPRLALAPLRNSARMDRREATVFLPPPPPPQPTQPQQQPAAAAVRAPVGGRGGGGGRQYRGVRMRKWGKWVAEIREPNKRSRIWLGSYSTAVAAARAYDTAVFYLRGRSARLNFPDQLDGAGGGGAGAGGAEDHRELTAAVIRKKAAEVGARVDAQHSVVGAAAPVPLQPPQPPPPQRRRTKNPDLNREPTPDTSDDE

SEQ ID NO: 179 - DNA, 579 bp, Brassica napus
atggagacagtgatggaagtggcggcggctgttcctacttcgacggttgcggcgccggcggcgacgaggaagagagagaaaccgtataaagggataaggatgaggaagtgggggaagtgggtggcggagattagagagcctaacaaacggtctaggatctggcttggctcttactcaactcccgaggcggcggcgagagcttacgacacggcggtgttctatctccgaggtccgtctgctcggcttaacttcccggagcttttagccggcgttacggtagcgggaggaaacggtggtggggatatgtcggcggcttacataaggagaaaagcagcggaggttggagcgcaagtggatgcgttagaagcggcgggaggcaatcgtcgtcatcatcatcatcaacagtatcaacgtggtaatcatgattacgtggatgatgatcatagtgttaatcatagtgattatcgccttaatgatggtcagcatgagtgtagtagtaaggataagaggtgtaacgggtcatgggaagctgtcgatttaaacaaattacccgacccggaaacttctgaggacgattag

SEQ ID NO: 180 - protein, 192 aa, Brassica napus
METVMEVAAAVPTSTVAAPAATRKREKPYKGIRMRKWGKWVAEIREPNKRSRIWLGSYSTPEAAARAYDTAVFYLRGPSARLNFPELLAGVTVAGGNGGGDMSAAYIRRKAAEVGAQVDALEAAGGNRRHHHHQQYQRGNHDYVDDDHSVNHSDYRLNDGQHECSSKDKRCNGSWEAVDLNKLPDPETSEDD

SEQ ID NO: 181 - DNA, 510 bp, Brassica napus
atggagacgggagcgaaagtaacggcggcgacgatggggatagggacgaggaaaagagatctgaaaccgtacaaagggatacggatgaggaaatgggggaagtgggtggctgagattagagaacccaacaagcgttccaggatctggctcggttcttactctactcccgaagcggcggcgagagcttacgacactgctgttttctacctccgtggtccttcggcgaggctcaatttcccggagcttttggctggacttactagttcaggcggtggtggagatatgtcggcagcggatataaggagaaaagcggcggaggttggtgctcaggtggacgcgctcggagcgacggtggtggtgaaacccggcgagagtctcggtggttacgaggataaggataactgtactggagttaagagcggtaacgggtcgttggaacgggtcgatttgaataagttgcccgacccggaaaattcggaagatgacgaccaatgggtgaagaggagatag

SEQ ID NO: 182 - protein, 169 aa, Brassica napus
METGAKVTAATMGIGTRKRDLKPYKGIRMRKWGKWVAEIREPNKRSRIWLGSYSTPEAAARAYDTAVFYLRGPSARLNFPELLAGLTSSGGGGDMSAADIRRKAAEVGAQVDALGATVVVKPGESLGGYEDKDNCTGVKSGNGSLERVDLNKLPDPENSEDDDQWVKRR

SEQ ID NO: 183 - DNA, 531 bp, Brassica napus
atggagacgggagcgaaagttacggcggcgacaggggcggtgacggcggcgacgatggggatagggacgaggaaaagagatctgaaaccgtacaaagggatacggatgaggaaatgggggaagtgggtggctgagattagagaacccaacaagcgttccaggatctggctcggttcttactctactcccgaagcggcggcgagagcttacgacactgctgttttctacctccgtggtccttcggcgaggctcaattttccggagcttttggctggacttactggttcaggcggtggtggagatatgtcggcggcgtatataaggagaaaagcggcggaggtcggtgctcaggtggacgcgctcggagcgacggtggtggttaaacccggcgagagtctcggtggttacgaggataaggataattgtaatggagttaagagcggtaacgggtcgttggagcgggtcgatttgaataaattgcccgacccggaaaattcggatgatgacgaccaatgggtgaagaggagatag

SEQ ID NO: 184 - protein, 176 aa, Brassica napus
METGAKVTAATGAVTAATMGIGTRKRDLKPYKGIRMRKWGKWVAEIREPNKRSRIWLGSYSTPEAAARAYDTAVFYLRGPSARLNFPELLAGLTGSGGGGDMSAAYIRRKAAEVGAQVDALGATVVVKPGESLGGYEDKDNCNGVKSGNGSLERVDLNKLPDPENSDDDDQWVKRR

SEQ ID NO: 185 - DNA, 531 bp, Arabidopsis thaliana
atggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatag

SEQ ID NO: 186 - protein, 176 aa, Arabidopsis thaliana
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 187 - DNA, 591 bp, Arabidopsis thaliana
atggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattag

SEQ ID NO: 188 - protein, 196 aa, Arabidopsis thaliana
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 189 - DNA, 594 bp, Brassica napus
atggagacagcgagggatgtggcggcggctgttcctgctttgacggttgcggcggcggcggcgacgaggaagagagagaaaccgtataaagggataaggatgaggaagtgggggaagtgggtggcggagatcagagagcctaataaacggtcgaggatatggcttggctcttactctactcctgaagcggcggctagagcttacgacacggcggtatactatctccggggtccgtccgctcggcttaacttcccggagcttttagccggcgttacggtggagggaggaaacggtggtggggatatgtcggcggcttatataaggagaaaagcggctgaggttggagctcaggtggatgcgttagaagcggcgggagggaatcgtcatcaccatcaccatcatcaacaacagcaacaacaacgaggaagtcatgagtacgtggatgatgatcatagtcttaatcatagtgactatcgtcttaatgatggtcacaacgagtgtagtagtaaggaagagtttaagaggtgtaacgggtcatgggaagcggtcgatttaaacaaactacccgacccggaaacatctgatgacgattaa

SEQ ID NO: 190 - protein, 197 aa, Brassica napus
METARDVAAAVPALTVAAAAATRKREKPYKGIRMRKWGKWVAEIREPNKRSRIWLGSYSTPEAAARAYDTAVYYLRGPSARLNFPELLAGVTVEGGNGGGDMSAAYIRRKAAEVGAQVDALEAAGGNRHHHHHHQQQQQQRGSHEYVDDDHSLNHSDYRLNDGHNECSSKEEFKRCNGSWEAVDLNKLPDPETSDDD

SEQ ID NO: 191 - DNA, 564 bp, Populus trichocarpa
taaaagtgattaatccacatataaggcttcatgattttgatcagccatataacatacctccttttggccatgttagcaacccatcggattaccaccggtggctaaactcctctcccactcatctccatcggaatcctctgggtcaggcaccttattcaggtcaaccggccgtgattttaactctctactatcaacgaccgtttcattattatcattgctactggtactattactactatttctttgacggtcatcgtgatggcggtggtggtggtggtttaacgctgtctcaaaagcatcgacacgagctccaacctcggttgctcttttccttatagaagcagctgacatgtccccatatgatccaccgcagctaaaattctctccagccaaaaattcaggaaaattcaacctcgccgacggtcctctcaaataaaaaacggcggtgtcataagcgcgagccgccgctacaggtgttgagtacgaaccaagccaaatccttgaccttttgttaggctctcttatctcagccacccattttccccacttcctcatccttattcc

SEQ ID NO: 192 - protein, 187 aa, Populus trichocarpa
MESGVDKEMATRKRGGMGSERQYKGIRMRKWGKWVAEIREPNKRSRIWLGSYSTPVAAARAYDTAVFYLRGPSARLNFPEFLAGENFSCGGSYGDMSAASIRKRATEVGARVDAFETALNHHHHRHHDDRQRNSSNSTSSNDNNETVVDSRELKSRPVDLNKVPDPEDSDGDEWERSLATGGNPMGC

SEQ ID NO: 193 - DNA, 549 bp, Populus trichocarpa
atggaaagtggagtagacaaggatatggcaacaagaaagagaggagggatagaaagtgagaggcaatacaaggggataaggatgaggaagtggggaaaatgggtggctgagataagagagcccaacaaaaggtcaaggatttggcttggttcctactcaacaccagtagcggcggctcgtgcttatgacaccgccgttttttatttgagagggccatcggcgaggctcaattttcctgaagttttggctgcagagggttttggtggcggtggatcatgcggggacatgtcagctgcttctataaggaaaagagcaactgaggttggagctcatgttgacgctatcgagacagcgttaaaccaccaccaccaccaccaccaccaccaccttcatcatgatgaccgtcaaagaaacagtaataatagtagcagtagtaatgataataatgaaacggtcgttgatagtagagagttgaagccacggccggttgacttgaataaggtgcctgacccagaggattccgatggagatgagtggaagaggagttaa

SEQ ID NO: 194 - protein, 182 aa, Populus trichocarpa
MESGVDKDMATRKRGGIESERQYKGIRMRKWGKWVAEIREPNKRSRIWLGSYSTPVAAARAYDTAVFYLRGPSARLNFPEVLAAEGFGGGGSCGDMSAASIRKRATEVGAHVDAIETALNHHHHHHHHHLHHDDRQRNSNNSSSSNDNNETVVDSRELKPRPVDLNKVPDPEDSDGDEWKRS

SEQ ID NO: 195 - DNA, 522 bp, Populus trichocarpa
atggaaagtggagtagacaaggatatggcaacaagaaagagaggcgggatagaaagtgagaggcaatacaaggggataaggatgaggaagtggggaaaatgggtggctgagataagagagcccaacaaaaggtcgaggatttggcttggttcctactcaacaccagtagcggcggctcgtgcttatgacaccgccgttttttatttgagagggccatcggcgaggctcaattttcctgaatttttggctggagagggttttggcgggggtggatcatgtggggacatgtcagctgcttctataaggaaaagagcaactgaggttggagctcatgttgacgctattgagacagcgttaaaccaccaccaccaccaccttcatcatgatgaccgtcaaagaaacagcaataatagtagcagtagtaatgataataatgaaacggtcgttgatagtaaagagttgaagccacggccggttgacttgaataaggtgcctgacccacaaggattccgatggagatga

SEQ ID NO: 196 - protein, 173 aa, Populus trichocarpa
MESGVDKDMATRKRGGIESERQYKGIRMRKWGKWVAEIREPNKRSRIWLGSYSTPVAAARAYDTAVFYLRGPSARLNFPEFLAGEGFGGGGSCGDMSAASIRKRATEVGAHVDAIETALNHHHHHLHHDDRQRNSNNSSSSNDNNETVVDSKELKPRPVDLNKVPDPQGFRWR

SEQ ID NO: 197 - DNA, 507 bp, Glycine max
atggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtcggtgctagagtcgatgctcttcaggcaacccttcaccaccactacgtgcccccgcggcaacttctctctggcggtggtggtgggtccggggatttcccggtgcgggttgttgacctgaataagatgcctgaacccgagagttcggactgtgagtgggatgtgaattga

SEQ ID NO: 198 - protein, 168 aa, Glycine max
MESEGRREGGERETTAATRKVEGAERRYKGIRMRKWGKWVAEIREPNKRSRIWLGSYSTPVAAARAYDTAVFYLRGPSARLNFPELLVREGPAALVAGCDMSAASIRKKATEVGARVDALQATLHHHYVPPRQLLSGGGGGSGDFPVRVVDLNKMPEPESSDCEWDVN

SEQ ID NO: 199 - DNA, 462 bp, Arabidopsis thaliana
atggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatag

SEQ ID NO: 200 - protein, 153 aa, Arabidopsis thaliana
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 201 - DNA, 540 bp, Triticum aestivum
atggagagggaagccacggtcgccttctacccgccggcgccggcgccgcagcagcagcgccccacggccgcgcagccgctctcggcccgcgtgcctgccggcggcgtccacgcgggccggggaggagggggcaggcagtaccgcggggtgcggatgcgcaagtggggcaagtgggtggccgagatccgggagcccaacaagcggtcgcggatctggctcggctcctacgccaccgccgtcgccgccgcgcgcgcctacgacaccgccgtcttctacctccgcggccgctccgcgcgcctcaacttccccgaccagctcctcgacggcactgcccccgccgccgcgcccggggacctcaccgccgccgccatccgcaagaaggccgccgaggtcggcgcgcgcgtcgacgcgctccactccggcggcatcggggtcggcatgggcgcccctgcggcaccgccgtcgccgtcccagcgccgcagggccaagaaccccgacctcaaccgggagcccacccccgacaccgacgacgacgagtga

SEQ ID NO: 202 - protein, 179 aa, Triticum aestivum
MEREATVAFYPPAPAPQQQRPTAAQPLSARVPAGGVHAGRGGGGRQYRGVRMRKWGKWVAEIREPNKRSRIWLGSYATAVAAARAYDTAVFYLRGRSARLNFPDQLLDGTAPAAAPGDLTAAAIRKKAAEVGARVDALHSGGIGVGMGAPAAPPSPSQRRRAKNPDLNREPTPDTDDDE

SEQ ID NO: 203 - DNA, 450 bp, Helianthus annuus
atggagccagccgccaccaccgccgccacttcatcaaactcaaaaccctacagaggaatccggatgcgcaagtggggcaaatgggttgccgaaattcgtgagccaaataaacgctcacgaatctggctcggctcctactcctcgccgatagccgccgcacgcgcttacgacacagctgttttctacctccgcggcccatcggctcggcttaattttcctgactcaattggagaatatggcggctgctccgccggcggcttacacgacctctcagccgcagctattcggaaaaaggctactgaagtcggcgcgaaagtggatgcgctggaaaaccagaacggcgcgagccggcagcgcgagccggtgggggttcaaaggtgttcgggtcgggtttgtttgaatacggatttgaatgagtacccgactccggaaacgtccgatgagaattaa

SEQ ID NO: 204 - protein, 149 aa, Helianthus annuus
MEPAATTAATSSNSKPYRGIRMRKWGKWVAEIREPNKRSRIWLGSYSSPIAAARAYDTAVFYLRGPSARLNFPDSIGEYGGCSAGGLHDLSAAAIRKKATEVGAKVDALENQNGASRQREPVGVQRCSGRVCLNTDLNEYPTPETSDEN

SEQ ID NO: 205 - DNA, 501 bp, Solanum lycopersicum
atggagataggtggtgggggtcaaagtggagttgctgcaaattcaggggtttgttgtggtgggaagagaaagaacgaaaagccctataaagggattcgtatgaggaagtggggaaaatgggttgcagaaattagagaacccaacaagcgttcgaggatttggttgggttcgtattcaacgccggtggctgcggctcgggcttatgatacggcggtctattatctaatatgcccttcggcccgattgaattttcccgagttgttagttggtgatggtgggcttaatgatttgtctgctgcttcgattcgtaaaaaagccatagaagttggtgctcaagtagatgctgtacagaactcgcttgcaacccatcataaccatacagaggaaaaggtgcactctgagacggcaagcccctcagaattgaagccttgttggtttcaagagaagcccgatttaaacttgaagcccgagcccgaagatccagaagtggattactggtaa

SEQ ID NO: 206 - protein, 166 aa, Solanum lycopersicum
MEIGGGGQSGVAANSGVCCGGKRKNEKPYKGIRMRKWGKWVAEIREPNKRSRIWLGSYSTPVAAARAYDTAVYYLICPSARLNFPELLVGDGGLNDLSAASIRKKAIEVGAQVDAVQNSLATHHNHTEEKVHSETASPSELKPCWFQEKPDLNLKPEPEDPEVDYW

SEQ ID NO: 207 - DNA, 555 bp, Arabidopsis thaliana
atggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaa

SEQ ID NO: 208 - protein, 184 aa, Arabidopsis thaliana
MEGGGVADVAVPGTRKRDRPYKGIRMRKWGKWVAEIREPNKRSRLWLGSYSTPEAAARAYDTAVFYLRGPTARLNFPELLPGEKFSDEDMSAATIRKKATEVGAQVDALGTAVQNNRHRVFGQNRDSDVDNKNFHRNYQNGEREEEEEDEDDKRLRSGGRLLDRVDLNKLPDPESSDEEWESKH

SEQ ID NO: 209 - DNA, 567 bp, Brassica napus
atggagggcggcggaggagtagctaacgtggcagtctccgggacgacgacgacgaggaagagagagagaccttacaagggtataaggatgaggaagtggggcaaatgggttgcggagattcgagagcctaacaagcgctctaggttatggctcggctcttactccacccccgaggcggctgctcgagcctacgacacggcggttttctacctcagaggaccgacggcgaggctcaacttccctgagcttcttaccggagagaaatttaccgaggaggatatgtcggccgcgacgatcaggaagaaagcaacggaggtgggtgctcaggtagacgctttgggctcggcggtgctagataaccgccaccgtgtttttggtcaggaccaagagagttgcgatgatagcaagaattttcgtcggaattatcaaaacggtgatggagaagaacatgaagacgatgatgaagacgagaagaggttgaagagtggcgggtggttattggaacgggttgacttgaataaactacccgacccggagagctccgatgaagactgggagagcaaataa

SEQ ID NO: 210 - protein, 188 aa, Brassica napus
MEGGGGVANVAVSGTTTTRKRERPYKGIRMRKWGKWVAEIREPNKRSRLWLGSYSTPEAAARAYDTAVFYLRGPTARLNFPELLTGEKFTEEDMSAATIRKKATEVGAQVDALGSAVLDNRHRVFGQDQESCDDSKNFRRNYQNGDGEEHEDDDEDEKRLKSGGWLLERVDLNKLPDPESSDEDWESK

SEQ ID NO: 211 - DNA, 468 bp, Populus trichocarpa
atggaaggagggtgctgtacatcgtcaacaagtactccaagttcaacttcaacagcaaccacagagaaacggaagcatagcaggcaacaaaaccaagagaagccatacagagggataaggatgaggaagtggggtaagtgggtagcagaaattagagaaccaaacaagaggtctaggatttggcttgggtcctactcaacaccaatagctgcagctcgtgcatacgacacggctgttttctatctgcgaggcccttctgctaggcttaatttccctgatttgatataccaagaagatgagctgcgagatgtgtctgctgcttctatacgcaagaaagccactgaagttggggctaaagtggatgccttacaaaccgctgtccatgcatcaccagaagataactcacgagtgttactttcagagaaacctgatttgaacaagttcccagaaaattctgatgaagagtga

SEQ ID NO: 212 - protein, 155 aa, Populus trichocarpa
MEGGCCTSSTSTPSSTSTATTEKRKHSRQQNQEKPYRGIRMRKWGKWVAEIREPNKRSRIWLGSYSTPIAAARAYDTAVFYLRGPSARLNFPDLIYQEDELRDVSAASIRKKATEVGAKVDALQTAVHASPEDNSRVLLSEKPDLNKFPENSDEE

SEQ ID NO: 213 - DNA, 453 bp, Glycine max
atggaaggagaaggaggaagcgcaaccagaaagagagggaaagatggtgagactgagacgacgacacgttacaaaggaatcagaatgagaaagtggggcaagtgggtcgctgagattcgagaacccaacaagcgttccaggatttggctcggttcttactccacgcccgtcgcggcggcgcgtgcttatgacaccgccgttttctatctccgggggccctccgcgcgcctcaacttcccggagcttctcgccgcggagggccccgccgcctccgacgccgtcatgtccgcggcctccatccggaagaaggccaccgaggttggcgcccgagtcgacgcacttcaccgccaggacccccacgcgccgcctgccggagaattcgccgaccgagtcgaccttaataagatacccgaacccgagaattccgattgtgactactggggcggggattag

SEQ ID NO: 214 - protein, 150 aa, Glycine max
MEGEGGSATRKRGKDGETETTTRYKGIRMRKWGKWVAEIREPNKRSRIWLGSYSTPVAAARAYDTAVFYLRGPSARLNFPELLAAEGPAASDAVMSAASIRKKATEVGARVDALHRQDPHAPPAGEFADRVDLNKIPEPENSDCDYWGGD

SEQ ID NO: 215 - DNA, 444 bp, Glycine max
atggaaggagaagaaggaggaattgcaacaaagaagagagggaaagagggtgaaactgagacgacgcgctacaaaggaatcagaatgagaaagtggggcaagtgggtcgctgagattcgagaacccaacaagcgttcaaggatttggctcggttcttactccacgcccgtcgcggcggcgcgtgcttacgacaccgccgttttccacctccggggcccctctgcgcgcctcaacttccccgagcttgttgccgcggagggccccgccgccgacatgtccgcagcctccatcaggaagaaggccaccgaggtcggcgccagagtcgacgctctccaccgccagcacccccacgcgctgcctgctggagaattcgccgaccgggttgaccttaataagatgcccgaacccgagaattcggattgtgactactgggacagggattag

SEQ ID NO: 216 - protein, 147 aa, Glycine max
MEGEEGGIATKKRGKEGETETTRYKGIRMRKWGKWVAEIREPNKRSRIWLGSYSTPVAAARAYDTAVFHLRGPSARLNFPELVAAEGPAADMSAASIRKKATEVGARVDALHRQHPHALPAGEFADRVDLNKMPEPENSDCDYWDRD

SEQ ID NO: 217 - DNA, 477 bp, Populus trichocarpa
atggaaggagagtgttatacatcaccaagtgcttcaagttcaactccaacaatatcaagcatagggaagcgtaagcatggtaggcaacaaaaccaggagaagccatatagagggataaggatgaggaagtggggtaagtgggtagctgaaattagagaaccaaacaagaggtctaggatttggcttgggtcctactcaacaccaattgctgcagctcgtgcatacgacacagccgttttctatctccgagggccttctgttaggcttaatttccctgatttgattcaccaagaagatgagttgtgtgatgtgtctgctgcttctatacgcaagaaagccactgaagtcggggctaaagttgatgccttgcaaacagctctccatgcatcaccaggagacaactcgccagcaaatcgactgttactttcagagaaacctgatttgaacgagtacccagagaattgtgatgaagagtga

SEQ ID NO: 218 - protein, 158 aa, Populus trichocarpa
MEGECYTSPSASSSTPTISSIGKRKHGRQQNQEKPYRGIRMRKWGKWVAEIREPNKRSRIWLGSYSTPIAAARAYDTAVFYLRGPSVRLNFPDLIHQEDELCDVSAASIRKKATEVGAKVDALQTALHASPGDNSPANRLLLSEKPDLNEYPENCDEE

SEQ ID NO: 219 - DNA, 525 bp, Glycine max
atggaagaaagagatcaccgttgttccaacaattcaacgatgatcacaacaacaaagaaaaaaacgagcagaagaagtcccacatcggataagctgaagaatcaacacccctgtgagaagcaggcgatgaaaccgtacagaggaataaggatgcgaaagtgggggaagtgggtggcggagatcagagaacccaacaagaggtcgaggatttggttgggttcgtacacgacacccatggccgccgcacgcgcctacgacacagccgttttctacctccgaggtcccaccgcacgccttaacttccccgaactcttgttccaggacgaccaggaggagggcaatgattcggtgcagcacggtgcagcagcagggaacatgtccgctgattccattcgccgaaaagccacgcaagtcggcgccagagtcgacgctctccaaaccgcgcttcaccaccacgcgtcaagtaccaactctctcaaacccgacttgaacgagtttccaaaactcgaatcccttcaagattga

SEQ ID NO: 220 - protein, 174 aa, Glycine max
MEERDHRCSNNSTMITTTKKKTSRRSPTSDKLKNQHPCEKQAMKPYRGIRMRKWGKWVAEIREPNKRSRIWLGSYTTPMAAARAYDTAVFYLRGPTARLNFPELLFQDDQEEGNDSVQHGAAAGNMSADSIRRKATQVGARVDALQTALHHHASSTNSLKPDLNEFPKLESLQD

SEQ ID NO: 221 - DNA, 543 bp, Medicago truncatula
atggaagaagaagatagggaatattgttgttcgatgaattcaagaacaaccaatagccctatagctatagatcataaaaataacaataacaataaggggatgaaaaaagagaaaaaagctatgaaaccatatagaggaataaggatgagaaagtggggtaagtgggtggcagagattagagaaccaaacaaaagatcaagaatttggttaggttcttacataacacctattgctgctgcacgtgcttatgatactgctgtgttttatcttagaggtccttctgcaaaccttaattttcctgaattgttgttcaaagatcaacaagaagatgaagaaaatctacaacaacatgggaatatgtcggctgattcaataaggaaaaaagctgcacaagttggtgctagagttgatgctattgaaactaattctctaattaatcatcatcatcatcatcatgtttcttccaataatcatgttcactccaattctacttcttctctcaaacctgacttgaatgagtttccaaaacctgaagattgttga

SEQ ID NO: 222 - protein, 180 aa, Medicago truncatula
MEEEDREYCCSMNSRTTNSPIAIDHKNNNNNKGMKKEKKAMKPYRGIRMRKWGKWVAEIREPNKRSRIWLGSYITPIAAARAYDTAVFYLRGPSANLNFPELLFKDQQEDEENLQQHGNMSADSIRKKAAQVGARVDAIETNSLINHHHHHHVSSNNHVHSNSTSSLKPDLNEFPKPEDC

SEQ ID NO: 223 - DNA, 483 bp, Glycine max
atggaagaagcgggtttaggagattgttgttcctctaatacgactattacgaggaaaagcgagaagcgaaagcagcagcaccaacaacaagagaagccatacagaggaataaggatgaggaagtggggcaagtgggtggcggagattagagaacccaacaagaggtcgaggatctggttgggttcttacgccacccccgtcgccgccgcacgcgcctacgacaccgccgtcttccacctccgaggcccttccgctcgcctcaacttccccgaattgctgtcccaggacgacgacgtttcgacccaacaacagggcaacatgtccgccgattcaattcgcaaaaaagccacccaagtcggcgccagagtcgacgcgctccaaaccgcgcttcagcaatcctcgtccacacactccattagttccagccacgtcagcagctatgagaaaccagacttgaacgagtatcccaaacctgaagattag

SEQ ID NO: 224 - protein, 160 aa, Glycine max
MEEAGLGDCCSSNTTITRKSEKRKQQHQQQEKPYRGIRMRKWGKWVAEIREPNKRSRIWLGSYATPVAAARAYDTAVFHLRGPSARLNFPELLSQDDDVSTQQQGNMSADSIRKKATQVGARVDALQTALQQSSSTHSISSSHVSSYEKPDLNEYPKPED

SEQ ID NO: 225 - DNA, 525 bp, Glycine max
atggaagacagggatcactgttgttccaacaattcaacgatgatcacaacaacaaagaaaagaacgggtagaagaagtccaacatcggataagctcaagaatcaacaccgcgagaagcagtcgatgaaaccttaccgtggaataaggatgcggaagtgggggaagtgggtggcggagatcagagaacccaacaaaaggtcgaggatatggttgggttcttacacgacacccgtggccgccgcacgtgcctacgacaccgctgtcttttacctccggggtcccaccgcgcgccttaacttccccgaactcttgttccaggacgacgaccaggagggcagtgattcggtgcagcacggcgcagcagggaacatgtccgctgattccattcgccgaaaagccacgcaagtcggcgccagagtcgacgctctccaaaccgcgcttcaccaccacgcgccaagtaccaactctctcaatctcaagcccgacttgaacgagtttccaaaactcgaagagcttcaagattga

SEQ ID NO: 226 - protein, 174 aa, Glycine max
MEDRDHCCSNNSTMITTTKKRTGRRSPTSDKLKNQHREKQSMKPYRGIRMRKWGKWVAEIREPNKRSRIWLGSYTTPVAAARAYDTAVFYLRGPTARLNFPELLFQDDDQEGSDSVQHGAAGNMSADSIRRKATQVGARVDALQTALHHHAPSTNSLNLKPDLNEFPKLEELQD

SEQ ID NO: 227 - DNA, 504 bp, Helianthus annuus
atggaagccagaaaacccttctccggcagcgtctccggtgacttaaactattctccggcggctggaaaaagaaagtccgatcaacgaccgtacaaagggatccggatgagaaagtggggaaagtgggtagccgaaattcgggagccgaataagcggtcgaggatatggctcggctcgtattcgactcccttagccgccgcacgggcgtatgacacggccgtgtactacctacgggggccgtcggctcggcttaacttcccggagttgatggcttctgatggcggcttggatgagctgagcacggcttctattaggaaaaaagctattgaagttggggctagagtagatgcagagacgtgttgtacgttggtgcataagagtggtacgtttgagcatcatcataattgtccttctagttctgagttgaagaaggcttgttggtttcaagaaaagcctgatttgaataagaaacccgaatccgaagacccggatggagattgttga

SEQ ID NO: 228 - protein, 167 aa, Helianthus annuus
MEARKPFSGSVSGDLNYSPAAGKRKSDQRPYKGIRMRKWGKWVAEIREPNKRSRIWLGSYSTPLAAARAYDTAVYYLRGPSARLNFPELMASDGGLDELSTASIRKKAIEVGARVDAETCCTLVHKSGTFEHHHNCPSSSELKKACWFQEKPDLNKKPESEDPDGDC

SEQ ID NO: 229 - DNA, 474 bp, Helianthus annuus
atggaagccatcatcaccggcggcggagatgggccgtgcaaccgtccgccggagaaaaggaagagtgatcaacggccgtacaaggggatacgcatgaggaagtggggaaaatgggtggcggagattcgggagccgaataagcggtccaggatttggttggggtcctattcgacgcccgtggccgctgcacgggcgtacgacacggccgtatactacctacggggcccgacggccaggttgaattttcccgaattattggggtctgacgtggcgttcggggagttgtcggcggcgagtattcggaaaaaggcgatagaggttggggccagagtggatgcagagacgagttgtacgtcgttgcttaggagtggtacgcgtgtacccgggtctgggcttaaggcgtgttggtttcaggagaaacccgacttgaatatgaaacccgaacccgaggagaatgatggagattattggtga

SEQ ID NO: 230 - protein, 157 aa, Helianthus annuus
MEAIITGGGDGPCNRPPEKRKSDQRPYKGIRMRKWGKWVAEIREPNKRSRIWLGSYSTPVAAARAYDTAVYYLRGPTARLNFPELLGSDVAFGELSAASIRKKAIEVGARVDAETSCTSLLRSGTRVPGSGLKACWFQEKPDLNMKPEPEENDGDYW

SEQ ID NO: 231 - DNA, 666 bp, Zea mays
atggaggcggagcaggcggcgatggcgagcgcggctgcgccgcagctggggtcggcgcaccagcaccagcaccagcaccagcagatgcagccgcggcggcagtaccgcggcgtgcgcatgcgcaagtggggcaagtgggtggcggagatccgggagccgcacaagcgcacgcgcatctggctggggtcctacgccacggccgtggcggcggcgcgcgcctacgacacggccgtgttctacctgcgcggccggtcggcgcggctcaacttccccgacgagatcccgtcgctggcgccgtcggagggcgagggcgacggcgacggcggggagcccgcgcgcgaccccgccgacggcggcggcggcggcacgctgtccgccgcgtccatccggaagaaggccatcgaggtggggtcccgcgtggacgcgctgcaaaccggcatgatggtgccgccgccgcaccaccgggagcgccagaagcaccaccatcaccaccacccaccacctgccgcagctgcggatgcacgccgccgccgcggaggcggcggcggcggagcaccggcaggaggtgaagcagtcgccgcagcggccggcgtggagcgggcgcgtcaagaacccggatctaaaccgggcgcccagccccgagagctccgacgccgagtgacatga

SEQ ID NO: 232 - protein, 221 aa, Zea mays
MEAEQAAMASAAAPQLGSAHQHQHQHQQMQPRRQYRGVRMRKWGKWVAEIREPHKRTRIWLGSYATAVAAARAYDTAVFYLRGRSARLNFPDEIPSLAPSEGEGDGDGGEPARDPADGGGGGTLSAASIRKKAIEVGSRVDALQTGMMVPPPHHRERQKHHHHHHPPPAAAADARRRRGGGGGGAPAGGEAVAAAAGVERARQEPGSKPGAQPRELRRRVT

SEQ ID NO: 233 - DNA, 660 bp, Zea mays
atggaggcggagcaggcggcgatggcgagcgcggctgcgccgcagctggggtcggcgcaccagcaccagcaccagcaccagcagatgcagccgcggcggcagtaccgcggcgtgcgcatgcgcaagtggggcaagtgggtggcggagatccgggagccgcacaagcgcacgcgcatctggctggggtcctacgccacggccgtggcggcggcgcgcgcctacgacacggccgtgttctacctgcgcggccggtcggcgcggctcaacttccccgacgagatcccgtcgctggcgccgtcggagggcgagggcgacggcgacggcggggagcccgcgcgcgaccccgccgacggcggcggcggcggcacgctgtccgccgcgtccatccggaagaaggccatcgaggtggggtcccgcgtggacgcgctgcaaaccggcatgatggtgccgccgccgcaccaccgggagcgccagaagcaccaccatcaccaccaccaccacctgccgcagctgcggatgcacgccgccgccgcggaggcggcggcggcggagcaccggcaggaggtgaagcagtcgccgcagcggccggcgtggagcgggcgcgtcaagaacccggatctaaaccgggcgcccagccccgagagctccgacgccgagtga

SEQ ID NO: 234 - protein, 219 aa, Zea mays
MEAEQAAMASAAAPQLGSAHQHQHQHQQMQPRRQYRGVRMRKWGKWVAEIREPHKRTRIWLGSYATAVAAARAYDTAVFYLRGRSARLNFPDEIPSLAPSEGEGDGDGGEPARDPADGGGGGTLSAASIRKKAIEVGSRVDALQTGMMVPPPHHRERQKHHHHHHHHLPQLRMHAAAAEAAAAEHRQEVKQSPQRPAWSGRVKNPDLNRAPSPESSDAE

SEQ ID NO: 235 - DNA, 624 bp, Zea mays
atggaggcggagcaggcggcgatggcggcgccgcagctgggggcggcgcaccagcagacgcagccgcggcggcagtaccgcggcgtgcgcatgcgcaagtggggcaagtgggtggcggagatccgggagccgcacaagcgcacgcgcatctggctggggtcctacgccacggccgtggcggcggcgcgcgcctacgacacggccgtgttctacctgcgcgggcggtcggcgcggctcaacttccccgaggagatcccctcgttcgggctggcggatggcgtggacgtgggggagcacgcgcgcgacccggccgccgccgccgccggcggcggcggcggctgcacgctgtccgcggcgtccatacggaagaaggccatcgaggtggggtcccgcgtggacgcgctccagaccggcatggtggtcccgccgccgcaccaccgcgagcgccataggcaccacaaccacctgccgcagctgcgggtgcacgcggaggagcagcaggaggaagaggaagcagaagccgcagcggcctgcgtggagcgggcgcgtcaagaacccggatctgaaccgtgcgccgagccccgagagctccgacgccgagtgacaagcgagcgagagagctga

SEQ ID NO: 236 - protein, 207 aa, Zea mays
MEAEQAAMAAPQLGAAHQQTQPRRQYRGVRMRKWGKWVAEIREPHKRTRIWLGSYATAVAAARAYDTAVFYLRGRSARLNFPEEIPSFGLADGVDVGEHARDPAAAAAGGGGGCTLSAASIRKKAIEVGSRVDALQTGMVVPPPHHRERHRHHNHLPQLRVHAEEQQEEEEAEAAAACVERARQEPGSEPCAEPRELRRRVTSERES

SEQ ID NO: 237 - DNA, 555 bp, Oryza sativum
atggataggagggaggccaccgtcttcttgcccccgccgccgccaccgcagccgacgcagccgcagcagcagcctgcggcggcggcggtgagggctccggtaggcgggaggggtgggggaggagggaggcagtatcgcggggtgcggatgcggaagtgggggaagtgggtggcggagatccgcgagccgaacaagcggtcgcggatctggctcggctcctactccaccgccgtcgccgccgcgcgggcctacgacaccgccgtgttctacctccgcggccgctccgcgcgcctcaacttccccgaccagctcgacggcgcgggtggtggtggcgcgggcgccggcggcgccgaggaccacagggagctcaccgccgccgtcatccgcaagaaggccgccgaggtcggcgcccgcgtcgacgcgcagcactccgtcgtcggcgccgcggcgcccgtgccgctccagccgccgcagcccccgccgccccagcgccgccggaccaagaaccccgacctcaaccgggagcccaccccggacacctccgacgacgagtag

SEQ ID NO: 238 - protein, 184 aa, Oryza sativum
MDRREATVFLPPPPPPQPTQPQQQPAAAAVRAPVGGRGGGGGRQYRGVRMRKWGKWVAEIREPNKRSRIWLGSYSTAVAAARAYDTAVFYLRGRSARLNFPDQLDGAGGGGAGAGGAEDHRELTAAVIRKKAAEVGARVDAQHSVVGAAAPVPLQPPQPPPPQRRRTKNPDLNREPTPDTSDDE

SEQ ID NO: 239 - DNA, 948 bp, Oryza sativum
atggataaccacgccgtcgcggtccagcaacgcgacacggcgccccggccccgcgcccgcgcgcgcgcctccgtatccagtatccagggggggggggggcctggctgggctgaccacgtcgccctcccacgcccgccacgttgccacccgcgccgccctcccaccccatgtcggcgaccgctcgcgttcgcgtcctcctccatccatccgcatcgcgccgtgctgccaagcggcgcgccgcctcacgtgtcggccggggcgcgcgacacgggcggcgcggcggggctcgcgcgaccccaccactcatttccccaggagaaaaagccgaagccaagacacgcaggtgtcgcctcgcctcgcctcgccctcgcgccgctgcggaattccgcgaggatggataggagggaggccaccgtcttcttgcccccgccgccgccaccgcagccgacgcagccgcagcagcagcctgcggcggcggcggtgagggctccggtaggcgggaggggtgggggaggagggaggcagtatcgcggggtgcggatgcggaagtgggggaagtgggtggcggagatccgcgagccgaacaagcggtcgcggatctggctcggctcctactccaccgccgtcgccgccgcgcgggcctacgacaccgccgtgttctacctccgcggccgctccgcgcgcctcaacttccccgaccagctcgacggcgcgggtggtggtggcgcgggcgccggcggcgccgaggaccacagggagctcaccgccgccgtcatccgcaagaaggccgccgaggtcggcgcccgcgtcgacgcgcagcactccgtcgtcggcgccgcggcgcccgtgccgctccagccgccgcagcccccgccgccccagcgccgccggaccaagaaccccgacctcaaccgggagcccaccccggacacctccgacgacgagtag

SEQ ID NO: 240 - protein, 315 aa, Oryza sativum
MDNHAVAVQQRDTAPRPRARARASVSSIQGGGGPGWADHVALPRPPRCHPRRPPTPCRRPLAFASSSIHPHRAVLPSGAPPHVSAGARDTGGAAGLARPHHSFPQEKKPKPRHAGVASPRLALAPLRNSARMDRREATVFLPPPPPPQPTQPQQQPAAAAVRAPVGGRGGGGGRQYRGVRMRKWGKWVAEIREPNKRSRIWLGSYSTAVAAARAYDTAVFYLRGRSARLNFPDQLDGAGGGGAGAGGAEDHRELTAAVIRKKAAEVGARVDAQHSVVGAAAPVPLQPPQPPPPQRRRTKNPDLNREPTPDTSDDE

SEQ ID NO: 241 - DNA, 540 bp, Brassica napus
atggacggcggcggagtagctgacgtggcagtcgccatgacgacgaggaagagagagagaccttacaagggcataaggatgaggaagtggggaaaatgggttgcggagattcgagagcctaacaagcggacaaggctatggcttggctcttactccactcccgaggcggcggcgcgagcttacgacacggcggttttctacctcagaggaccaacggcgaggctcaacttccctgagtttcttaccggagagaaattctccgaggaggacatgtcgggtgatacgattaggaaaaaagcgacggaggtcggtgctcaggtagacgctttgggcacggcggtgctaaatagccgccaccgtgtgtttggtcagaacggagagagtgatgatagtgataagaattttcatcggagttatcgaaacggtgagtcagaagaagatgataagagtttgaagagtggcggctggttattggaacgggttgacttgaataaggtacccgacccggaaaactccgatgacgactgggaaagcaaataa

SEQ ID NO: 242 - protein, 179 aa, Brassica napus
MDGGGVADVAVAMTTRKRERPYKGIRMRKWGKWVAEIREPNKRTRLWLGSYSTPEAAARAYDTAVFYLRGPTARLNFPEFLTGEKFSEEDMSGDTIRKKATEVGAQVDALGTAVLNSRHRVFGQNGESDDSDKNFHRSYRNGESEEDDKSLKSGGWLLERVDLNKVPDPENSDDDWESK

SEQ ID NO: 243 - DNA, 540 bp, Brassica napus
atggacggcggcggagcagctgacgtggcagtcgccgtgacgacgaggaagagagagagaccttacaagggcataaggatgaggaagtggggaaaatgggttgcggagattcgagagcctaacaagcggacaaggctatggctcggctcttactccactcctgaggcggcggcgcgagcctacgacacggcggttttctacctcagaggaccaacggcgaggctcaacttccctgagtttcttaccggagagaaattctccgaggaggacatgtcgggcgatacgattaggaaaaaagcgacggaggtcggtgctcaggtagacgctttgggcacggcggtgctaaataaccgccaccgtgtgtttggtcagaacggagagagtgatgatagtaataagaattttcatcggaattatcgaaacggtgagtcagaagaagatgataagagtttgaagagtggcggctggttattggaacgggttgacttgaataaggtacccgacccggaaaactccgatgacgactgggaaagcaaataa

SEQ ID NO: 244 - protein, 179 aa, Brassica napus
MDGGGAADVAVAVTTRKRERPYKGIRMRKWGKWVAEIREPNKRTRLWLGSYSTPEAAARAYDTAVFYLRGPTARLNFPEFLTGEKFSEEDMSGDTIRKKATEVGAQVDALGTAVLNNRHRVFGQNGESDDSNKNFHRNYRNGESEEDDKSLKSGGWLLERVDLNKVPDPENSDDDWESK

SEQ ID NO: 245 - DNA, 462 bp, Arabidopsis thaliana
atggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatag

SEQ ID NO: 246 - protein, 153 aa, Arabidopsis thaliana
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 247 - DNA, 1164 bp, Arabidopsis thaliana
atcaaaaaatctctatccatccacaacaacaacaaaaactcaagaacaatatctccacttgatcactaccacattgtccaatcactctacaaagcctgtacgtacacaacaacattaccatggtgaaacaagaacgcaagatccaaaccagcagcacaaaaaaggaaatgcctttgtcatcatcaccatcttcttcttcttcttcatcttcttcctcgtcttcgtcttcgtgtaagaacaagaacaagaagagtaagattaagaagtacaaaggagtgaggatgagaagttggggatcatgggtctctgagattagggcaccaaatcaaaagacaaggatttggttaggttcttactcaacagctgaagcagctgctagagcttacgatgttgcactcttatgtctcaaaggccctcaagccaatctcaacttccctacttcttcttcttctcatcatcttcttgataatctcttagatgaaaatacccttttgtcccccaaatccatccaaagagtagctgctcaagctgccaactcatttaaccattttgcccctacttcatcagccgtctcgtcaccgtccgatcatgatcatcaccatgatgatgggatgcaatctttgatgggatcttttgtggacaatcatgtgtctttgatggattcaacatcttcatggtatgatgatcataatgggatgttcttgtttgataatggagctccattcaattactctcctcaactaaactcgacgacgatgctcgatgaatacttctacgaagatgctgacattccgctttggagtttcaattaatccgacggtccataatacatactttaattagttttctaaatcattttttaaattcttttttatatatgtaacatatatttaccctcgtcgtaattattcatttccaagttgtttgttgcttggagagaattgacgacggatacgattatataatataattgtaagtttttatatgtagcaaactcggtacaattcggatttaatagggatctaggaagttcacatgaacaagcgactcttttttttgtcacttctttgactttttcatgtgaggtttcttttcatcaattttttttaacaatgtgtgaaaatatttctgtattgtaatgatatatttcgcacaatagttttg

SEQ ID NO: 248 - protein, 230 aa, Arabidopsis thaliana
MVKQERKIQTSSTKKEMPLSSSPSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 249 - DNA, 939 bp, Arabidopsis thaliana
ctcatattcccaacacttgttcaagcatatctaagtcaataacaacattacaacataacatggtgaaacaagaactcaagatccaagttactacttcctcatcatcactctctcattcttcatcttcttcttcttcttcaacgtcggcactacgtcatcaatcttgtaagaacaagataaagaagtataaaggtgtgaggatgcgaagttggggatcatgggttactgaaattagggcaccaaatcaaaagacaagaatctggttaggttcttactccaccgcagaagcagctgctagggcttacgacgctgctctcttgtgtcttaagggacctaaagctaatctcaacttccctaacatcaccactacttctccttttcttatgaacatcgacgaaaagacccttttgtccccaaaatcaatccaaaaggtcgccgctcaagccgctaactcctcttctgaccattttacccctccgtccgatgaaaatgatcatgatcatgatgacggactcgatcaccatccatctgcttcttcttcagctgcatcttcaccaccagatgatgatcatcataatgatgacgatggtgatttggtatcgttgatggaatctttcgtggattacaacgaacacgtgtctctgatggatccatcgctgtatgaatttggacataatgagatcttcttcaccaacggagatccgtttgattattctccacagttacatagctcagaggcaacgatggatgacttctacgacgatgttgatattccgctatggagtttcagttaatccaacggtccatattattatactacgaaacacttttaattcacattatttcatttaatttattctttcaattcatattattcgtccttgttgtttcgttatgtattaaatatacacacactaatttaagaagatcacatggact

SEQ ID NO: 250 - protein, 244 aa, Arabidopsis thaliana
MVKQELKIQVTTSSSSLSHSSSSSSSSTSALRHQSCKNKIKKYKGVRMRSWGSWVTEIRAPNQKTRIWLGSYSTAEAAARAYDAALLCLKGPKANLNFPNITTTSPFLMNIDEKTLLSPKSIQKVAAQAANSSSDHFTPPSDENDHDHDDGLDHHPSASSSAASSPPDDDHHNDDDGDLVSLMESFVDYNEHVSLMDPSLYEFGHNEIFFTNGDPFDYSPQLHSSEATMDDFYDDVDIPLWSFS

SEQ ID NO: 251 - DNA, 720 bp, Arabidopsis thaliana
atggtgaaaacacttcaaaagacaccaaagagaatgtcatctccatcatcatcatcttcatcatcctcatcaacatcatcatcatccataaggatgaagaagtacaagggagtgagaatgagaagttggggttcatgggtttcagagatcagagctcctaatcaaaagacaaggatctggcttggttcttactcaactgctgaagccgcggctagagcctacgacgcagcactcctatgtcttaaaggatcctcagctaataatctcaacttcccagagatctcaacttctctctaccatattatcaacaatggtgataacaacaatgacatgtcccctaagtctatacaaagagtagcagctgcagctgctgctgccaacacagatccttcctcatcatcagtctctacttcatctccattgctttcctctccatctgaagatctctatgatgttgtctccatgtcacagtatgaccaacaagtctccttgtctgaatcatcatcatggtacaactgctttgatggtgatgatcagttcatgttcattaatggagtctccgcgccgtatttgacaacatcactttctgatgatttctttgaggaaggagatatcagattatggaacttctgctgattctactttcattataccttattctttgtttcaatatatatacttgagttatgtaacttatacaatgtgttatacatttttttc

SEQ ID NO: 252 - protein, 211 aa, Arabidopsis thaliana
MVKTLQKTPKRMSSPSSSSSSSSSTSSSSIRMKKYKGVRMRSWGSWVSEIRAPNQKTRIWLGSYSTAEAAARAYDAALLCLKGSSANNLNFPEISTSLYHIINNGDNNNDMSPKSIQRVAAAAAAANTDPSSSSVSTSSPLLSSPSEDLYDVVSMSQYDQQVSLSESSSWYNCFDGDDQFMFINGVSAPYLTTSLSDDFFEEGDIRLWNFC

SEQ ID NO: 253 - DNA, 960 bp, Arabidopsis thaliana
ctgctttcaatacccttacttttcagtttccacagtccctgtacttgtgcataaaactgtaaaacactactctgaaaattttgcttctgttaggatataatgccaccctctcctcctaaatctccttttattagctcttcactcaaaggagctcatgaagatcgcaaatttaaatgctataggggtgtccgaaagaggtcttggggcaaatgggtgtctgaaatcagagttccaaagactggacgacgaatatggctaggttcatacgatgctccagagaaggcagctagagcctatgatgctgctttgttctgtattaggggtgagaagggagtttacaattttcccactgataaaaagccgcagcttccagaaggttctgtccggcctctgtccaagctcgacatacagacaatagcaacaaactatgcttcatcagttgtgcatgtaccttcccatgccaccacactcccggcaacaacccaggttccctctgaagttcctgcttcctctgatgtttctgcttctactgagattacagagatggtcgatgaatattatctcccaaccgatgcaactgcagaatcaatattctcagttgaagacttacaactggacagtttcctcatgatggacattgattggataaacaatctaatctgatgtgtaacgtcacttgcagtgacatttaatatggtttaactatcagttacctgtctgcttcttgtaagggtatacttggatccttgtctttgaacttgttttatttagcatgcagtttgttgtttctgttttgcatgtgttcttccttatgagatgttggatatgaatgaaatgattaggagttggcgttcacacctaaatctttgttgcatgtttgatgcattttttcctatatcgttcacacatgatctgcctctttttctatacttctacttctacataaaccatactaggact

SEQ ID NO: 254 - protein, 187 aa, Arabidopsis thaliana
MPPSPPKSPFISSSLKGAHEDRKFKCYRGVRKRSWGKWVSEIRVPKTGRRIWLGSYDAPEKAARAYDAALFCIRGEKGVYNFPTDKKPQLPEGSVRPLSKLDIQTIATNYASSVVHVPSHATTLPATTQVPSEVPASSDVSASTEITEMVDEYYLPTDATAESIFSVEDLQLDSFLMMDIDWINNLI

SEQ ID NO: 255 - DNA, 946 bp, Arabidopsis thaliana
ctatactgtcagctccaaaacatacctgaataagtgaatatacattaaaacctaatctatcatcatatccatctctttccctctctgcatttagagatatggatgcatccccaaagtacacaggtgtacggaagaggaagtggggaaaatgggtggctgagattcgtctccccaacagccgtgacaggatctggttaggctctttcgactctgctgagaaggcggcgcgtgctttcgacgcggctctttactgtcttcgtggccccggagcacgcttcaacttccccgacaatcctccggagattcccggtggtcgttctctgacgccgcagcagattcaggtcgtagctagccgtttcgcctgcgaggaggagctactaccaccggaacaacatcatccgtcaccgccacgtggcgaccataataccgaggaagaagtgataatttcggcacgtggggaaattaatagtggtagtggtgggcctacgttagggcaagttggggaagataataacaacgagggtaatagtaatgacacgtcgtcgtattggcctttaatatgggaggaggagaattttgtaggtcctcctaactcagatcatgagttcggttttttcacagatgattcaaccaatttgtacttcccgacacaacaacaacaacaacatcagctctcgtctgatttttactatgatggagcttgtgaagatgatttctctcattacaatattaacctttggaatttctgagatccatttttttggtgatcttggaccaaatattcctatattgattaattcaatttgtggatttcgaattcgagatttcaaatgatcttgaaccagaattttcaccacccactagtagtgtgaatcatttgtttgaactttgaagcgaatcctatatgccacaatgtaagcaagcctgagtaatagcttcactactt

SEQ ID NO: 256 - protein, 216 aa, Arabidopsis thaliana
MDASPKYTGVRKRKWGKWVAEIRLPNSRDRIWLGSFDSAEKAARAFDAALYCLRGPGARFNFPDNPPEIPGGRSLTPQQIQVVASRFACEEELLPPEQHHPSPPRGDHNTEEEVIISARGEINSGSGGPTLGQVGEDNNNEGNSNDTSSYWPLIWEEENFVGPPNSDHEFGFFTDDSTNLYFPTQQQQQHQLSSDFYYDGACEDDFSHYNINLWNF

SEQ ID NO: 257 - DNA, 709 bp, Arabidopsis thaliana
atggaagggtcgtcttcttcgatgcagtcaaagtacaaaggagtgaggaagaggaaatggggaaaatgggtttcagagatcagacttcccaacagcagagaacgtatttggttgggctcttacgatactcctgagaaggcggcgcgtgctttcgacgcggctctttattgtctccgtggcaacaacgcaaagttcaatttccctgataatcctccggtgatctccggcggacgtaacttgtcgcgatctgagataagagaagctgctgcgaggttcgctaattcggcggaggatgattcaagtggcggagcaggatacgagatacggcaagaatctgcttcaacatcgatggacgttgattcggagtttttgagtatgcttccgacggttggttcgggtaacttcgcttcggagtttgggttattccctgggtttgatgatttctccgatgaatactccggtgatcgtttcagagagcagctttcgcctacacaagattattatcagcttggagaagagacttacgccgatggttccatgtttctttggaatttttgaattccattattcacaatctgaaaattttgacttgggttttttatttttttttgtagttctttacccaatttttttttgatcattgggataaagagttattcattcactatttttttcccacgtgttagatttttcagatgggaaaaggcca

SEQ ID NO: 258 - protein, 185 aa, Arabidopsis thaliana
MEGSSSSMQSKYKGVRKRKWGKWVSEIRLPNSRERIWLGSYDTPEKAARAFDAALYCLRGNNAKFNFPDNPPVISGGRNLSRSEIREAAARFANSAEDDSSGGAGYEIRQESASTSMDVDSEFLSMLPTVGSGNFASEFGLFPGFDDFSDEYSGDRFREQLSPTQDYYQLGEETYADGSMFLWNF

SEQ ID NO: 259 - DNA, 918 bp, Arabidopsis thaliana
aaccagatataacagaattaacctacacaactgaaactcgagttaagaaccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttc

SEQ ID NO: 260 - protein, 195 aa, Arabidopsis thaliana
MVKQAMKEEEKKRNTAMQSKYKGVRKRKWGKWVSEIRLPHSRERIWLGSYDTPEKAARAFDAAQFCLRGGDANFNFPNNPPSISVEKSLTPPEIQEAAARFANTFQDIVKGEEESGLVPGSEIRPESPSTSASVATSTVDYDFSFLDLLPMNFGFDSFSDDFSGFSGGDRFTEILPIEDYGGESLLDESLILWDF

SEQ ID NO: 261 - DNA, 807 bp, Arabidopsis thaliana
aaacaacactcaaaagtctcttcttcttcttcttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaatatgtttctgatc

SEQ ID NO: 262 - DNA, 582 bp, Arabidopsis thaliana
tctacacgactttattccgcttcaacgtatttatatgcaacattttccctcatgatcttataatctcatcttcatccacccaaaaacatggattcaagagacaccggagaaactgaccagagcaagtacaaaggtatccgtcgtcggaaatggggaaaatgggtatcagagattcgtgtcccgggaactcgtcaacgtctctggttaggctctttctccaccgcagaaggcgctgccgtagcccacgacgtcgctttttactgcttgcaccgaccatcttccctcgacgacgaatcttttaacttccctcacttacttacaacctccctcgcctccaatatatctcctaagtccatccaaaaagctgcttccgacgccggcatggccgtggacgccggattccatggtgctgtgtctgggagtggtggttgtgaagagagatcttccatggcgaatatggaggaggaggacaaacttagtatctccgtgtatgattatcttgaagacgatctcgtttgatctatacgagtacgtttttagcagttaatataggatgtgcaaagggttaggatctgtttactt

SEQ ID NO: 263 - protein, 144 aa, Arabidopsis thaliana
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 264 - protein, 143 aa, Arabidopsis thaliana
MDSRDTGETDQSKYKGIRRRKWGKWVSEIRVPGTRQRLWLGSFSTAEGAAVAHDVAFYCLHRPSSLDDESFNFPHLLTTSLASNISPKSIQKAASDAGMAVDAGFHGAVSGSGGCEERSSMANMEEEDKLSISVYDYLEDDLV

SEQ ID NO: 265 - protein, 41 aa, Artificial sequence
  Motif 25: AP2/ERF domain
  misc_feature (2)..(2): Xaa can be any naturally occurring amino acid
  misc_feature (4)..(4): Xaa can be any naturally occurring amino acid
  misc_feature (6)..(6): Xaa can be any naturally occurring amino acid
  misc_feature (9)..(9): Xaa can be any naturally occurring amino acid
  misc_feature (12)..(12): Xaa can be any naturally occurring amino acid
  misc_feature (16)..(16): Xaa can be any naturally occurring amino acid
  misc_feature (18)..(21): Xaa can be any naturally occurring amino acid
  misc_feature (23)..(23): Xaa can be any naturally occurring amino acid
  misc_feature (28)..(33): Xaa can be any naturally occurring amino acid
  misc_feature (36)..(36): Xaa can be any naturally occurring amino acid
  misc_feature (38)..(38): Xaa can be any naturally occurring amino acid
  misc_feature (40)..(40): Xaa can be any naturally occurring amino acid
GXRXRXWGXWVXEIRXPXXXXRXWLGSXXXXXXAAXAXDXA

SEQ ID NO: 266 - protein, 5 aa, Artificial sequence
  Motif 26: CMII-1
  misc_feature (2)..(4): Xaa can be any naturally occurring amino acid
IXXXA

SEQ ID NO: 267 - protein, 6 aa, Artificial sequence
  Motif 27: CMII-2
  misc_feature (2)..(2): Xaa can be any naturally occurring amino acid
  misc_feature (4)..(5): Xaa can be any naturally occurring amino acid
DXNXXP

SEQ ID NO: 268 - protein, 4 aa, Artificial sequence
  Motif 28: CMII-3
  misc_feature (3)..(3): Xaa can be any naturally occurring amino acid
LWXF

SEQ ID NO: 269 - DNA, 2194 bp, Oryza sativa; identical to SEQ ID NO: 91

SEQ ID NO: 270 - DNA, 53 bp, Artificial sequence
  primer: prm14304
ggggacaagtttgtacaaaaaagcaggcttaaacaatggacggtggaagagga

SEQ ID NO: 271 - DNA, 51 bp, Artificial sequence
  primer: prm14305
ggggaccactttgtacaagaaagctgggttccaatatcaattaacatccca

SEQ ID NO: 272 - DNA, 2568 bp, Arabidopsis thaliana
atggattataataggcaacgactacttgtagtggctaacaggctcccagtttctgccgtgagaagaggtgaagattcatggtctcttgagatcagtgctggtggtctagtcagtgctctcttaggtgtaaaggaatttgaggccagatggataggatgggctggagttaatgtgcctgatgaggttggacagaaggcacttagcaaagctttggctgagaagaggtgtattcccgtgttccttgatgaagagattgttcatcagtactataatggttactgcaacaatattctgtggcctctgtttcactaccttggacttccgcaagaagatcggcttgccacaaccagaagctttcagtcccaatttgctgcatacaagaaggcaaaccaaatgttcgctgatgttgtaaatgagcactatgaagagggagatgtcgtctggtgccatgactatcatcttatgttccttcctaaatgccttaaggagtacaacagtaagatgaaagttggatggtttctccatacaccattcccttcgtctgagatacacaggacacttccatcacgatcagagctccttcgctcagttcttgctgctgatttagttggcttccatacatatgactatgcaaggcactttgtgagtgcgtgcactcgtattcttggacttgaaggaacacctgagggagttgaggatcaaggcaggctcactcgtgtagctgcttttccaattggcatagattctgatcggtttatacgagcacttgaggtccccgaagtcatacaacacatgaaggaattgaaagaaagatttgctggcagaaaggtgatgttaggtgttgatcgtcttgacatgatcaaagggattccacaaaagattctggcattcgaaaaatttctcgaggaaaatgcaaactggcgtgataaagtggtcttattgcaaattgcggtgccaacaagaactgacgttcctgagtatcaaaaactcacaagccaagttcatgaaattgttggacgcattaatggtcgttttgggacactgactgcagttccaatacatcatctggatcggtctctggactttcatgctttatgtgcactttatgccgtcacagatgttgcgcttgtaacatctttgagagatgggatgaatcttgtcagttatgagtttgttgcttgccaagaggccaaaaagggcgtcctcattctcagtggatttgcaggtgctgcacagtctctgggtgctggagctattcttgtgaatccttggaacatcacagaagttgctgcctccattggacaagccctaaacatgacagctgaagaaagagagaaaagacatcgccataattttcatcatgtcaaaactcacactgctcaagaatgggctgaaacttttgtcagtgaactaaatgacactgtaattgaggcgcaactacgaattagtaaagtcccaccagagcttccacagcatgatgcaattcaacggtattcaaagtccaacaacaggcttctaatcctgggtttcaatgcaacattgactgaaccagtggataatcaagggagaagaggtgatcaaataaaggagatggatcttaatctacaccctgagcttaaagggcccttaaaggcattatgcagtgatccaagtacaaccatagttgttctgagcggaagcagcagaagtgttttggacaaaaactttggagagtatgacatgtggctggcagcagaaaatgggatgttcctaaggcttacgaatggagagtggatgactacaatgccagaacacttgaacatggaatgggttgatagcgtaaagcatgttttcaagtacttcactgagagaactcccaggtcacactttgaaactcgcgatacttcgcttatttggaactacaaatatgcagatatcgaattcgggagacttcaagcaagagatttgttacaacacttatggacaggtccaatctctaatgcatcagttgatgttgtccaaggaagccgctctgtggaagtccgtgcagttggtgtcacaaagggagctgcaattgatcgtattctaggagagatagtgcatagcaagtcgatgactacaccaatcgattacgtcttgtgcattggtcatttcttggggaaggacgaagatgtttacactttcttcgaaccagaacttccatccgacatgccagccattgcacgatccagaccatcatctgacagtggagccaagtcatcatcaggagaccgaagaccaccttcaaagtcgacacataacaacaacaaaagtggatcaaaatcctcatcatcctctaactctaacaacaacaacaagtcctcacagagatctcttcagtcagagagaaaaagtggatccaaccatagcttaggaaactcaagacgtccttcaccagagaagatctcatggaatgtgcttgacctcaaaggagagaactacttctcttgcgctgtgggtcgtactcgcaccaatgctagatatctccttggctcacctgacgacgtcgtttgcttccttgagaagctcgctgacaccacttcctcacct

SEQ ID NO: 273 - protein, 856 aa, Arabidopsis thaliana
MDYNRQRLLVVANRLPVSAVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVIQHMKELKERFAGRKVMLGVDRLDMIKGIPQKILAFEKFLEENANWRDKVVLLQIAVPTRTDVPEYQKLTSQVHEIVGRINGRFGTLTAVPIHHLDRSLDFHALCALYAVTDVALVTSLRDGMNLVSYEFVACQEAKKGVLILSGFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSP

SEQ ID NO: 274 - DNA, 2562 bp, Arabidopsis thaliana
tataataggcaacgactacttgtagtggctaacaggctcccagtttctgccgtgagaagaggtgaagattcatggtctcttgagatcagtgctggtggtctagtcagtgctctcttaggtgtaaaggaatttgaggccagatggataggatgggctggagttaatgtgcctgatgaggttggacagaaggcacttagcaaagctttggctgagaagaggtgtattcccgtgttccttgatgaagagattgttcatcagtactataatggttactgcaacaatattctgtggcctctgtttcactaccttggacttccgcaagaagatcggcttgccacaaccagaagctttcagtcccaatttgctgcatacaagaaggcaaaccaaatgttcgctgatgttgtaaatgagcactatgaagagggagatgtcgtctggtgccatgactatcatcttatgttccttcctaaatgccttaaggagtacaacagtaagatgaaagttggatggtttctccatacaccattcccttcgtctgagatacacaggacacttccatcacgatcagagctccttcgctcagttcttgctgctgatttagttggcttccatacatatgactatgcaaggcactttgtgagtgcgtgcactcgtattcttggacttgaaggaacacctgagggagttgaggatcaaggcaggctcactcgtgtagctgcttttccaattggcatagattctgatcggtttatacgagcacttgaggtccccgaagtcatacaacacatgaaggaattgaaagaaagatttgctggcagaaaggtgatgttaggtgttgatcgtcttgacatgatcaaagggattccacaaaagattctggcattcgaaaaatttctcgaggaaaatgcaaactggcgtgataaagtggtcttattgcaaattgcggtgccaacaagaactgacgttcctgagtatcaaaaactcacaagccaagttcatgaaattgttggacgcattaatggtcgttttgggacactgactgcagttccaatacatcatctggatcggtctctggactttcatgctttatgtgcactttatgccgtcacagatgttgcgcttgtaacatctttgagagatgggatgaatcttgtcagttatgagtttgttgcttgccaagaggccaaaaagggcgtcctcattctcagtggatttgcaggtgctgcacagtctctgggtgctggagctattcttgtgaatccttggaacatcacagaagttgctgcctccattggacaagccctaaacatgacagctgaagaaagagagaaaagacatcgccataattttcatcatgtcaaaactcacactgctcaagaatgggctgaaacttttgtcagtgaactaaatgacactgtaattgaggcgcaactacgaattagtaaagtcccaccagagcttccacagcatgatgcaattcaacggtattcaaagtccaacaacaggcttctaatcctgggtttcaatgcaacattgactgaaccagtggataatcaagggagaagaggtgatcaaataaaggagatggatcttaatctacaccctgagcttaaagggcccttaaaggcattatgcagtgatccaagtacaaccatagttgttctgagcggaagcagcagaagtgttttggacaaaaactttggagagtatgacatgtggctggcagcagaaaatgggatgttcctaaggcttacgaatggagagtggatgactacaatgccagaacacttgaacatggaatgggttgatagcgtaaagcatgttttcaagtacttcactgagagaactcccaggtcacactttgaaactcgcgatacttcgcttatttggaactacaaatatgcagatatcgaattcgggagacttcaagcaagagatttgttacaacacttatggacaggtccaatctctaatgcatcagttgatgttgtccaaggaagccgctctgtggaagtccgtgcagttggtgtcacaaagggagctgcaattgatcgtattctaggagagatagtgcatagcaagtcgatgactacaccaatcgattacgtcttgtgcattggtcatttcttggggaaggacgaagatgtttacactttcttcgaaccagaacttccatccgacatgccagccattgcacgatccagaccatcatctgacagtggagccaagtcatcatcaggagaccgaagaccaccttcaaagtcgacacataacaacaacaaaagtggatcaaaatcctcatcatcctctaactctaacaacaacaacaagtcctcacagagatctcttcagtcagagagaaaaagtggatccaaccatagcttaggaaactcaagacgtccttcaccagagaagatctcatggaatgtgcttgacctcaaaggagagaactacttctcttgcgctgtgggtcgtactcgcaccaatgctagatatctccttggctcacctgacgacgtcgtttgcttccttgagaagctcgctgacaccacttcctcacct

SEQ ID NO: 275 - protein, 854 aa, Arabidopsis thaliana
YNRQRLLVVANRLPVSAVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVIQHMKELKERFAGRKVMLGVDRLDMIKGIPQKILAFEKFLEENANWRDKVVLLQIAVPTRTDVPEYQKLTSQVHEIVGRINGRFGTLTAVPIHHLDRSLDFHALCALYAVTDVALVTSLRDGMNLVSYEFVACQEAKKGVLILSGFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSP

SEQ ID NO: 276 - DNA, 2466 bp, Arabidopsis thaliana
atggattatgatgatgcacgtggtgaaaggccaagattgcttgtggtggctaacaggcttccggtttctgcaaagaggaccggggaaaattcttggtctctggaaatgagtcctggtggtttagtcagtggtcttctaggtataacatctcaatttgataccaaatgggttggatggcccggagttgatgtgcatgatgaaattgaaaaaaatgcactcactgaatctctagccgaaatgaagtgtatccctgtgttccttaatggggtttttgatcagtactacaatggttattgcaatggtatcttgtggccaattcttcatcacatgggacttccacaagaagatcagcatgacacaaaccaaactttcgaaacacaatatgatgcatacaagaaagcaaatcgaatgtttcttgatgtcataatagacaactatgaagaaggagatattgtttggtgtcatgactatcatctcatgtttcttcctcaataccttaaagagtacaacaacaaaatcaaagttggatggtttctccattcaccatttccttcttctgaggtctacaaaacattgccctcgcggtcagagcttcttcgtgcgattcttgcagctgatttacttggcttccatacatatgattttgcaagacatttcttgagtacatgcactcgaattcttggagttgaaggaacacatgaaggagttgtgtatcaaggcagagtcactcgagtagctgtttttcccattggaatagatcctgatcggtttataagaacatgtaagctccctgaagtcacacagcaaatgaatgagcttcaagagaagtttgctggcaaaaaggtgatattaggtgttgatcgtcttgatatgatcaaagggatcccacaaaagtatcttgcatttgagaagtttctagaagaaaatccatattggcgtgataaagttgtgctagtgcaaattgcagtgccaacaagaaatgatgtccctgaatatcgaaagctcaaaagccaagtccatggactcgttggtcgcataaacggtcgttttggttctgtctcttctcttccaatccatcatctggattgttctgttgacttcaactacttatgtgcaatatacgcaattgcagatgtaatgcttgtaacatctttgagagatggaatgaatcttgttagttatgaatttgttgcttgtcaagaagccaaaaagggggttcttgttctcagtgagtttgcaggtgctggccagtctcttggtgttggagctcttattgtgaatccttgggatgttacagaagtttcttctgccattaaagaagctctaaatatgccagctgaagaaagagaaacaagacacagatctaattttcagtatgtgtgtactcattctgctgaaaaatggggattagatttcatgagtgaactcaatggcattattcctgaatccgagatgcaaatgaggaaaatcccacttcaacttccagaacaagatgtgattcaacaatattcgcaatctaacaatagactaataatattgggtttctttggaacactcgcagagccaatgaatagtggaactaaggaaatggatcttaaactaaacccagagctaaaaggaacactgaaagcattgtgcaatgatccaaaaacaacagtagttgtattgagtagaagtggcaaaaacatattaaacaagaattttggagagtctaatatatggctggctgcggaaaatggaatgttcgaaaagcagacaactggagaatgggtgacaaatatgcctcaaaacgtgaaccttgattgggtcgatggtgtaaagaatgtttttaagtatttcactgatcgaactccaagatcgtacttcgaagcaagcgagacttcgctcgtatggaattatgaatatgcagatgttgaatttgggagagcacaagcaagagacttgttacaatacctatgggcaggaccaatctctaatgcatcagttgatgttgttcgaggaaaccattctgttgaagtccatgccattggtgagactaagggggcagcaattggtcgtattttgggagaaatagtgcacagaaaatctatgaccacaccgattgattttgtcttttgtagtggttacttcttggagaaggacgaagacatttacacattcttcgaatcaaaaatcttgtcgtccaagtcaccgaacggtctcgacctcaagaaagagaattacttctctgcagccattggacaagctcgcacaaaagctcgctatgtcatagactcagctcacggtgttgtagatttgctccacaagcttgcagttgttgcagatacaacaatgactgactcattttctgatagcgaaatatatgagcctcgcgatgcaaatgcaaatgaaaattcgaaacgctggatcaattctgtcagaagaaggaaagtggaaattggagacactgggcaaatcggcatgtaa

SEQ ID NO: 277 - protein, 821 aa, Arabidopsis thaliana
MDYDDARGERPRLLVVANRLPVSAKRTGENSWSLEMSPGGLVSGLLGITSQFDTKWVGWPGVDVHDEIEKNALTESLAEMKCIPVFLNGVFDQYYNGYCNGILWPILHHMGLPQEDQHDTNQTFETQYDAYKKANRMFLDVIIDNYEEGDIVWCHDYHLMFLPQYLKEYNNKIKVGWFLHSPFPSSEVYKTLPSRSELLRAILAADLLGFHTYDFARHFLSTCTRILGVEGTHEGVVYQGRVTRVAVFPIGIDPDRFIRTCKLPEVTQQMNELQEKFAGKKVILGVDRLDMIKGIPQKYLAFEKFLEENPYWRDKVVLVQIAVPTRNDVPEYRKLKSQVHGLVGRINGRFGSVSSLPIHHLDCSVDFNYLCAIYAIADVMLVTSLRDGMNLVSYEFVACQEAKKGVLVLSEFAGAGQSLGVGALIVNPWDVTEVSSAIKEALNMPAEERETRHRSNFQYVCTHSAEKWGLDFMSELNGIIPESEMQMRKIPLQLPEQDVIQQYSQSNNRLIILGFFGTLAEPMNSGTKEMDLKLNPELKGTLKALCNDPKTTVVVLSRSGKNILNKNFGESNIWLAAENGMFEKQTTGEWVTNMPQNVNLDWVDGVKNVFKYFTDRTPRSYFEASETSLVWNYEYADVEFGRAQARDLLQYLWAGPISNASVDVVRGNHSVEVHAIGETKGAAIGRILGEIVHRKSMTTPIDFVFCSGYFLEKDEDIYTFFESKILSSKSPNGLDLKKENYFSAAIGQARTKARYVIDSAHGVVDLLHKLAVVADTTMTDSFSDSEIYEPRDANANENSKRWINSVRRRKVEIGDTGQIGM

SEQ ID NO: 278 - DNA, 2193 bp, Arabidopsis thaliana
atgggttatgataatgtatgtggtgaaaggcaaacactgcttgtggtggctaaccggcttccagcttctgcaaagagaaccggggaacattcttggtctctggaaatgagtcctggtggcaaatttaatcttctagttgaaaaagatgcagtctctaaatctctggctgaaatgaagtgtatccctgtattccttaatgaggtttttgatcaatactacaatggttatagcaatggtatattgtggccaattcttcatcacatgggacttccacaagaatatgatcatgacacaatcaaaactttcgaaacccaatatgatgcatacaagaaagcaaatcgaatgtttcttgatgtcataaaagagaattataaagatggagatattgtttggtgccaagattatcatctcatgtttcttcctcaatatcttaaagagtacaacaataaaatcaaagttggatggtttctccattcaccatttccttcttccgagatttataaaacattgccctcacgatcagagcttcttcgttcggttcttgcagctgatttaattagttttcacacatatgattttgcaagacatttcgtgaatacatgcacccgaattcttggagttgaaggaacacatgaaggagttgtgtatcaaggaagagtcactcgagtggttgttcttcccatgggaatatatccaaatcggtttataaaaacatgtaagctccctgaagtaattcaacaaatgaatgagcttaaagatagattttctggcaaaaaggtgatattaggtgttgatcgtcttgatatgatcaaagggattccacaaaagtatcttggatttgagaaatttctggatgaaaatcctaattggcgcgataaaattgtgctagtgcaaattgcagtaccaacaagaaatgaagtccctgaatatcaaaagctcaaaaaccaagttcatagactggttggacgcataaacggtcgttttggttctgtctcttctcttccaattcaccacatggattgttctgttgactccaattacttatgcgcactttatgcgatttcagatgtaatgcttgtaacatctttgagagacggattgaatcttgttagtcatgaatttgttgcttgccaagaggccaaaagaggggttcttattctcagtgagtttgcaggtgctggacagtctcttggtgctggagctctacttgtgaatccttggaatgttacagaagtttcttctgcaattaaaaaagctctaaatatgccatatgaggaaagagaaacaagacacagagttaattttaagtatgtaaaaactcattctgctgaaaaatgggggtttgatttcttgagtgaactcaatgacgctttcgatgaatccgagttgcaaattaggaaaattccacatgaacttccacaacaagatgtgatacaacgatattcgttgtcgaacaatagactgataatcttgaactttggagagtataagatatggttggctgcggaaaatggaatgttcctaaagcatactactgaagaatgggtgacaaatatgcctcaaaacatgaaccttgattgggttgatggtctcaagaatgtttttaagtacttcactgatcgaactccaagatcgttcttcgaagcaagcaagacttcgcttgtatggaattacgaatatgcagatgttgaatttgggagagcacaagcaagagacttgttacaatacttatgggcaggaccaatctctaatgcatcagctgaagttgttcgaggaaaatattctgttgaagtccatgccattggtgtgactaaggaaccagaaattggtcatattttgggagaaatagtgcacaaaaaagctatgactacaccgattgattatgtattttgcagtggttacttcttggagaaggacgaagacatctatacattcttcgaatcagaaatcttgtcgcccaagttatctcatgaaacaagatcgaagtcttcttcaagtaaccactccctagagaagaaggtttcattgaacgttcttgacctcaagcaagagaattacttctctacagccataggacaagctcgcacaaaagctcgctatgtcgttgactcatctcacaatgttgtgaatttactccacaagcttgcagtagcaaatacaacaacaacaagtgtcaagaagccaaacgtttaa

SEQ ID NO: 279 - protein, 730 aa, Arabidopsis thaliana
MGYDNVCGERQTLLVVANRLPASAKRTGEHSWSLEMSPGGKFNLLVEKDAVSKSLAEMKCIPVFLNEVFDQYYNGYSNGILWPILHHMGLPQEYDHDTIKTFETQYDAYKKANRMFLDVIKENYKDGDIVWCQDYHLMFLPQYLKEYNNKIKVGWFLHSPFPSSEIYKTLPSRSELLRSVLAADLISFHTYDFARHFVNTCTRILGVEGTHEGVVYQGRVTRVVVLPMGIYPNRFIKTCKLPEVIQQMNELKDRFSGKKVILGVDRLDMIKGIPQKYLGFEKFLDENPNWRDKIVLVQIAVPTRNEVPEYQKLKNQVHRLVGRINGRFGSVSSLPIHHMDCSVDSNYLCALYAISDVMLVTSLRDGLNLVSHEFVACQEAKRGVLILSEFAGAGQSLGAGALLVNPWNVTEVSSAIKKALNMPYEERETRHRVNFKYVKTHSAEKWGFDFLSELNDAFDESELQIRKIPHELPQQDVIQRYSLSNNRLIILNFGEYKIWLAAENGMFLKHTTEEWVTNMPQNMNLDWVDGLKNVFKYFTDRTPRSFFEASKTSLVWNYEYADVEFGRAQARDLLQYLWAGPISNASAEVVRGKYSVEVHAIGVTKEPEIGHILGEIVHKKAMTTPIDYVFCSGYFLEKDEDIYTFFESEILSPKLSHETRSKSSSSNHSLEKKVSLNVLDLKQENYFSTAIGQARTKARYVVDSSHNVVNLLHKLAVANTTTTSVKKPNV

SEQ ID NO: 280 - DNA, 2829 bp, Arabidopsis thaliana
atgcctggaaataagtacaactgcagttcttctcatatcccactctctcgaacagaacgcctcttgagagatagagagcttagagagaagaggaagagcaaccgagctcgtaatcctaatgacgttgctggcagttccgagaactctgagaatgacttgcgtttagaaggtgacagttcaaggcagtatgttgaacagtacttggaaggggctgctgctgcaatggcgcacgatgatgcgtgtgagaggcaagaagttaggccttataataggcaacgactacttgtagtggctaacaggctcccagtttctgccgtgagaagaggtgaagattcatggtctcttgagatcagtgctggtggtctagtcagtgctctcttaggtgtaaaggaatttgaggccagatggataggatgggctggagttaatgtgcctgatgaggttggacagaaggcacttagcaaagctttggctgagaagaggtgtattcccgtgttccttgatgaagagattgttcatcagtactataatggttactgcaacaatattctgtggcctctgtttcactaccttggacttccgcaagaagatcggcttgccacaaccagaagctttcagtcccaatttgctgcatacaagaaggcaaaccaaatgttcgctgatgttgtaaatgagcactatgaagagggagatgtcgtctggtgccatgactatcatcttatgttccttcctaaatgccttaaggagtacaacagtaagatgaaagttggatggtttctccatacaccattcccttcgtctgagatacacaggacacttccatcacgatcagagctccttcgctcagttcttgctgctgatttagttggcttccatacatatgactatgcaaggcactttgtgagtgcgtgcactcgtattcttggacttgaaggaacacctgagggagttgaggatcaaggcaggctcactcgtgtagctgcttttccaattggcatagattctgatcggtttatacgagcacttgaggtccccgaagtcatacaacacatgaaggaattgaaagaaagatttgctggcagaaaggtgatgttaggtgttgatcgtcttgacatgatcaaagggattccacaaaagattctggcattcgaaaaatttctcgaggaaaatgcaaactggcgtgataaagtggtcttattgcaaattgcggtgccaacaagaactgacgttcctgagtatcaaaaactcacaagccaagttcatgaaattgttggacgcattaatggtcgttttgggacactgactgcagttccaatacatcatctggatcggtctctggactttcatgctttatgtgcactttatgccgtcacagatgttgcgcttgtaacatctttgagagatgggatgaatcttgtcagttatgagtttgttgcttgccaagaggccaaaaagggcgtcctcattctcagtgaatttgcaggtgctgcacagtctctgggtgctggagctattcttgtgaatccttggaacatcacagaagttgctgcctccattggacaagccctaaacatgacagctgaagaaagagagaaaagacatcgccataattttcatcatgtcaaaactcacactgctcaagaatgggctgaaacttttgtcagtgaactaaatgacactgtaattgaggcgcaactacgaattagtaaagtcccaccagagcttccacagcatgatgcaattcaacggtattcaaagtccaacaacaggcttctaatcctgggtttcaatgcaacattgactgaaccagtggataatcaagggagaagaggtgatcaaataaaggagatggatcttaatctacaccctgagcttaaagggcccttaaaggcattatgcagtgatccaagtacaaccatagttgttctgagcggaagcagcagaagtgttttggacaaaaactttggagagtatgacatgtggctggcagcagaaaatgggatgttcctaaggcttacgaatggagagtggatgactacaatgccagaacacttgaacatggaatgggttgatagcgtaaagcatgttttcaagtacttcactgagagaactcccaggtcacactttgaaactcgcgatacttcgcttatttggaactacaaatatgcagatatcgaattcgggagacttcaagcaagagatttgttacaacacttatggacaggtccaatctctaatgcatcagttgatgttgtccaaggaagccgctctgtggaagtccgtgcagttggtgtcacaaagggagctgcaattgatcgtattctaggagagatagtgcatagcaagtcgatgactacaccaatcgattacgtcttgtgcattggtcatttcttggggaaggacgaagatgtttacactttcttcgaaccagaacttccatccgacatgccagccattgcacgatccagaccatcatctgacagtggagccaagtcatcatcaggagaccgaagaccaccttcaaagtcgacacataacaacaacaaaagtggatcaaaatcctcatcatcctctaactctaacaacaacaacaagtcctcacagagatctcttcagtcagagagaaaaagtggatccaaccatagcttaggaaactcaagacgtccttcaccagagaagatctcatggaatgtgcttgacctcaaaggagagaactacttctcttgcgctgtgggtcgtactcgcaccaatgctagatatctccttggctcacctgacgacgtcgtttgcttccttgagaagctcgctgacaccacttcctcaccttaa

SEQ ID NO: 281 - protein, 942 aa, Arabidopsis thaliana
MPGNKYNCSSSHIPLSRTERLLRDRELREKRKSNRARNPNDVAGSSENSENDLRLEGDSSRQYVEQYLEGAAAAMAHDDACERQEVRPYNRQRLLVVANRLPVSAVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVIQHMKELKERFAGRKVMLGVDRLDMIKGIPQKILAFEKFLEENANWRDKVVLLQIAVPTRTDVPEYQKLTSQVHEIVGRINGRFGTLTAVPIHHLDRSLDFHALCALYAVTDVALVTSLRDGMNLVSYEFVACQEAKKGVLILSEFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSP

SEQ ID NO: 282 - DNA, 2388 bp, Arabidopsis thaliana
atggcaaggccacgactgcttgtagtgtcgatgtcgcttccggtcactgcaaagaggactggagaagagtcttggtctttcacgatgagtcctggtggtctagttagtgctcttctaggtttgaaagaatttgagaccaaatggattggatggcctggagtagatgttcatgatgcgattggcaaaaagacactctccattaccctagctgaaaagggatgtatcccagtgtttttggaagaagtgtgtgatcaatactataatggctactgcaacaatattctgtggccgatttttcactacttgggaacgccaccagaatatcgtaacgatgcaaccataacataccagtcacagtatgaagcatacaagaaagcaaatcaaattttctttgatgttgtcaaagagcactatgaagaaggagatgtggtttggtgccatgattatcatgttatgcttcttcctcaatatcttaaggaatacaacagtaagatgaaagttggatggtttctccatacaccatttccttcttccgagatgtacaaaacattgccctcgcgatccgatctgcttcgttctgttcttactgctgatttagttggtttccatacctatgacttcgcaagacattttttgaatgcatgcatgtgtattcttggagtcgaagcaacatctgaaggaattgtggatcagggcaaagtcactcgagtagctgtttttcccattgggatagaacctgagaggtttataaacacaagtgaactctctgaagttgttcaatacatgaagaagttcaaaaacgattttggtgggagaaagttgatattaggtgttgatcgtctcgatacgatcaaagggattccacaaaaatatcaggcatttgagaagttcttagaggaaaatgcagagtggcgtggtaaagtcatgttacttcagattgcagtgccaacaaggaacggtattggtgaatatcaaaagatcaaagaccaatgtcattaccatgttggacgaattaatggtcgttttggttccatctcttctgttccaataattcacctggattgttctattgactttaatcaattatgcgcactttatgccatcacagatgtattacttgtaacatctctgagagatggaatgaaccttgtgagttctgaattcattgcctgccaaaaagcagaaaaaggggttctcattctaagcgagtttgcaggtgctggacagtcacttggtgccggagctattttagtgaatccttggaacattaaagaagtttcttctgccattggagaagctctaaatatgtcacatgaagaaaaggagagaaaacataaaatcaattttcagtatgtgaaaactcactccactcagcagtgggcagatgatttcatgaaattgactcttacaaacattttatgcagtaaacttattgagattacaaccagcgcggagctaggagctggattagccgccacacttgaacttccagaacatgatgtgattcaacaatactcaaagtctaacaatagactgctgattcttggattctatggaacgctcactcagccgatgaaaaatcaagagagaagaggcgacggaatgaatcttgaactgcatccacagctaaaagagagactcaaagaattatgcagtgatccaaaaacaacagtagttgtcctgagtagaagtgaaaaatgcatattggataaaaactttggagaatataacatgtggttggctgctgaaaatgggatgtttctaaggcatacaagtggagaatgggtgacaagaattccagaacacatgaatttggaatggattgatggtgttaagcatgttttcaagtacttcactgaaagaactccaggatcatatctcgaaacaagcgaggcttcgcttgtatggaactacgaaaatgcagatgctgaattcgggagagctcaagcaagagacatgttacaacacttgtgggcaggaccaatctctaatgcctcagtggatgttgttagaggaggccaatctgttgaagtccatgccgttggtgtgacaaagggaagtgcaatggagcgtattctcggagaaatagtgcataacaagtcaatggctacaccaattgactatgtcttgtgcattggttgtttcttggggaaagacgaagacgtttacacattcttcgagccagagttgaccaagaaagccaagtcgctttcttcttcaggtagtgactcccccaagaaggtatcatcgaccattgttgacctcaagggagagaattacttctccgtagctattggacaaacgcacacaaaggctcgctatttccttgactcatctgatgacgttgtgaaacttattggcaagctttgcacacacaacaatgcttga

SEQ ID NO: 283 - protein, 795 aa, Arabidopsis thaliana
MARPRLLVVSMSLPVTAKRTGEESWSFTMSPGGLVSALLGLKEFETKWIGWPGVDVHDAIGKKTLSITLAEKGCIPVFLEEVCDQYYNGYCNNILWPIFHYLGTPPEYRNDATITYQSQYEAYKKANQIFFDVVKEHYEEGDVVWCHDYHVMLLPQYLKEYNSKMKVGWFLHTPFPSSEMYKTLPSRSDLLRSVLTADLVGFHTYDFARHFLNACMCILGVEATSEGIVDQGKVTRVAVFPIGIEPERFINTSELSEVVQYMKKFKNDFGGRKLILGVDRLDTIKGIPQKYQAFEKFLEENAEWRGKVMLLQIAVPTRNGIGEYQKIKDQCHYHVGRINGRFGSISSVPIIHLDCSIDFNQLCALYAITDVLLVTSLRDGMNLVSSEFIACQKAEKGVLILSEFAGAGQSLGAGAILVNPWNIKEVSSAIGEALNMSHEEKERKHKINFQYVKTHSTQQWADDFMKLTLTNILCSKLIEITTSAELGAGLAATLELPEHDVIQQYSKSNNRLLILGFYGTLTQPMKNQERRGDGMNLELHPQLKERLKELCSDPKTTVVVLSRSEKCILDKNFGEYNMWLAAENGMFLRHTSGEWVTRIPEHMNLEWIDGVKHVFKYFTERTPGSYLETSEASLVWNYENADAEFGRAQARDMLQHLWAGPISNASVDVVRGGQSVEVHAVGVTKGSAMERILGEIVHNKSMATPIDYVLCIGCFLGKDEDVYTFFEPELTKKAKSLSSSGSDSPKKVSSTIVDLKGENYFSVAIGQTHTKARYFLDSSDDVVKLIGKLCTHNNA

SEQ ID NO: 284 - DNA, 2580 bp, Oryza sativa
atgccgacccccgcgccgtcggcatcgtcctcctcctcctcctgcggcggcggtggcggtggcgccggggccgcgtcgtcctactcctcctccccggacgaccgcatgctccgcggggagtgcggccgccgccaccccttcgcgtcgtcggcggcggtgggggccggttccccggacgccatggacacggactccgcggagccttcctccgcggcgacctccgtcgcggacttcggggcccggtcgccgttctcgccgggggccgcctcgcccgccaacatggacgacgcgggcggcgcgtcggcggcggggcacgcggcgcggccgccgctcgccgggccgcgcagcgggttccgccgcctcggcctccgcgggatgaagcagcgcctcctcgtcgtcgccaaccgcctccccgtctccgccaatcgccgcggcgaggaccagtggtccctggagatcagcgccggcggcctcgtcagcgccctcctcggcgtcaaggacgtggacgcgaagtggatcggatgggcgggcgtcaacgtccccgacgaggtcggccagcgagctctcacccgagcgctcgccgagaagagatgtataccagtgttcctggatgaggaaatcgtgcaccaatactacaacggatactgcaacaacatactctggcctctgtttcactacctgggattgccacaggaggacaggttggcgacgacgaggaatttcgagtcacagttcaacgcgtacaagcgagcaaaccagatgttcgctgatgttgtgtaccagcactacaaggaaggggatgtgatctggtgccatgattaccacctcatgttcctgcccaagtgcctcaaggatcatgacatcaacatgaaggtcgggtggttcctgcacacgccattcccttcttcggagatttaccggacgctgccctcccggtcggagctgcttcgctccgtgctctgtgctgatttagtcggatttcatacatatgattatgcaagacattttgtgagcgcatgtacaagaatacttggactggagggcactcctgagggtgtggaagaccaaggaaggctaaccagagttgctgcgtttcctattgggatagactctgaacgtttcaagcgagcattggagcttccagcagtaaaaagacacatcactgaattaacacaacgttttgatggtcgaaaggtaatgcttggtgttgaccgacttgacatgatcaaaggaattccgcaaaagattttggcctttgaaaagtttctcgaagaaaaccatgaatggaatgataaagtggttctacttcaaattgctgtgccgacaagaactgatgtccctgagtatcaaaagcttacaagtcaggtgcatgaaattgttgggcgcataaatggccgatttggaacactgactgctgttcctattcatcatctggaccgatctcttgatttccatgccttgtgtgccctttatgcagtcactgatgtggcccttgtaacatcgctgagagatggaatgaatcttgtaagctatgaatatgttgcatgccaaggatcaaaaaaaggagttttgatattgagtgagtttgctggggcagcacagtctcttggagccggtgctattttagtaaacccctggaatattactgaagtcgcagactcaatcaagcatgctttgacaatgtcatctgatgagagagaaaagcgacataggcataactatgctcatgtgacaactcacactgcacaagattgggccgaaacttttgtatgtgagttaaatgagacagttgctgaagctcagctgagaacaagacaagttccacctgatctccctagtcaagcagcaattcaacaatatctgcattccaaaaatcggttgctcatattggggttcaattcaacattgactgagccagttgaatcctctgggagaaggggtggtgaccaaatcaaggaaatggagctcaagttgcatcctgagttgaagggccctttgagagccctctgtgaggatgagcatactacagttattgttcttagtggaagtgacaggagcgtccttgatgaaaatttcggagaattcaatatgtggttagcagcagagcatggcatgtttttacgtccaactaatggagagtggatgacaacaatgcctgagcatctgaacatggattgggtagacagtgtaaagaatgtttttgaatactttacagaaagaaccccaaggtctcattttgaacaccgtgagacatcatttgtatggaattacaagtatgctgatgttgagtttggacggctccaagcaagagatatgctgcagcacttgtggacaggtccaatctcaaatgcagcagtcgatgttgttcaaggaagccgatcagttgaagttcggtctgtcggagttacaaagggtgctgcaattgatcgtattctaggagagatagttcatagcaaaagcatgattactccaattgattatgttctatgcattgggcacttcctaggaaaggtaattatgcaattaatttatatgtgcatatccgtttctttcagtgcaaggtgctttttttgtctttga

SEQ ID NO: 285 - protein, 859 aa, Oryza sativa
MPTPAPSASSSSSSCGGGGGGAGAASSYSSSPDDRMLRGECGRRHPFASSAAVGAGSPDAMDTDSAEPSSAATSVADFGARSPFSPGAASPANMDDAGGASAAGHAARPPLAGPRSGFRRLGLRGMKQRLLVVANRLPVSANRRGEDQWSLEISAGGLVSALLGVKDVDAKWIGWAGVNVPDEVGQRALTRALAEKRCIPVFLDEEIVHQYYNGYCNNILWPLFHYLGLPQEDRLATTRNFESQFNAYKRANQMFADVVYQHYKEGDVIWCHDYHLMFLPKCLKDHDINMKVGWFLHTPFPSSEIYRTLPSRSELLRSVLCADLVGFHTYDYARHFVSACTRILGLEGTPEGVEDQGRLTRVAAFPIGIDSERFKRALELPAVKRHITELTQRFDGRKVMLGVDRLDMIKGIPQKILAFEKFLEENHEWNDKVVLLQIAVPTRTDVPEYQKLTSQVHEIVGRINGRFGTLTAVPIHHLDRSLDFHALCALYAVTDVALVTSLRDGMNLVSYEYVACQGSKKGVLILSEFAGAAQSLGAGAILVNPWNITEVADSIKHALTMSSDEREKRHRHNYAHVTTHTAQDWAETFVCELNETVAEAQLRTRQVPPDLPSQAAIQQYLHSKNRLLILGFNSTLTEPVESSGRRGGDQIKEMELKLHPELKGPLRALCEDEHTTVIVLSGSDRSVLDENFGEFNMWLAAEHGMFLRPTNGEWMTTMPEHLNMDWVDSVKNVFEYFTERTPRSHFEHRETSFVWNYKYADVEFGRLQARDMLQHLWTGPISNAAVDVVQGSRSVEVRSVGVTKGAAIDRILGEIVHSKSMITPIDYVLCIGHFLGKVIMQLIYMCISVSFSARCFFCL

SEQ ID NO: 286 - DNA, 2769 bp, Populus tremuloides
atgcctggaaaccagtacaacggtaactctacccttaactcaggtcgtgtcggacggctcttaaagataagagagcaaaggagaagtatcaggtctgcctattcaaatgaggtaactgataaccatagaggaactgaagcatgtgaaaatgatttgcgcacgcgagaaggtgacagcttaaacaattcatttatcgaacaatacttggaaggtgctatcgcagagggatatgaaaagctggatgtcaggcctttaaggcaacggctgttggtggtagctaatagactacctgtatctgcagttagaagaggtgaagactcatggtctttggagataagtgctgggggcttagtcactgctcttctaggtgtaaaggagtttgaggcgaaatggattggttgggctggagttaatgtgccagatgaagttggccagaaggcgcttactgaagctttggctgaaaagaggtgtattccggtattccttgacgaagagattgttcatcaatattataatggctactgcaacaatatattgtggcccctctttcattaccttgggcttccacaagaagatcgacttgccacgaccagaagtttccagtctcagtttgctgcatataagaaggcaaaccaaatgtttgctgatgtggtgaatcagcactatgaggagggtgatgttgtctggtgccatgattaccatttgatgtacctcccaaaatgccttaaggaatacaataataatatgaaagttggttggtttctccacacaccctttccttcttctgaaatccataggacgctgccatctcgatcagacctactacgttctgttcttgcagccgatttagttgggtttcacacctatgactatgcaagacattttgttagtgcttgtactcgtattcttgggctagagggcacacctgaaggcgttgaggatcaagggaggctgactcgagttgctgcgtttcccattgggatagactcagatcggttcataagagctcttgaactccctcaagtccaggaacacatcaaagaactgaaggaaagatttgctggccgaaaggtaatgctaggtgttgaccgccttgatatgattaaaggaattccacagaagattcttgcatttgaaaaatttctcgaggagaattccgcctggcgtgataaagttgttctactgcagattgctgtgccaacaagaacagatgttcctgagtatcaaaaacttacaagccaagttcatgaaattgttggacgcattaatggcagatttggaacattaactgctgttccaatacaccacctggatcgctctctcgacttccatgccttgtgtgctttatatgcagttaccgatgttgctcttgtaacttctttaagggatggaatgaatctcgtcagttatgagtttgtagcatgccaagattcgaagaaaggtgtgctcattcttagtgagtttgcaggtgcagcccaatctctaggtgctggagcaatccttgtgaatccttggaacatcactgaagttgctgattcaatacgccaagctctaactatgtcccctgaagaaagagagaagcgacatcgccacaactttgtccatgtgacaacccacactgctcaagaatgggctgaaacttttgtgagtgaactagatgatacagttatcgaggcacaactaaggaccaagcaagtgccacctgcacttccagaagaagatgcaattagtcgttatttgcagtctactaatcgattgctcatactgggattcaatgcaacattgactgagccagcggacactcctgggagaagagctgatcaaattaaagaaatggaacttaaattgcacccagagttaaaagaagcattgacagcactttgcagtgatagaaagacaaccattgttgttctcagtgggagtgaccgaaaaacattagatgataactttggggagtatgacatgtggttggcagcagaacatggaatgtttttgcgacttacaaagggagaatggatgacaacaatgccagaacacttaaatatggaatgggttgacagtgtgaagcatgtttttgagtacttcacagaacgtactccccgatcacattttgaacgctgtgaaacatcacttgtatggaattacaagtatgcagatgttgaatttgggaggcttcaagcaagggatatgttgcaacacctctggacgggcccaatttcaaatgcctctgttgatgtggtccaagggaatcgatcagttgaggttcgagcagttggtgttacaaagggtgctgctattgatcgtatactgggagagattgtccatagtaaatccatgacaacaccaattgattatgtcctatgcattggccattttctgggaaaggatgaagatgtgtacaccttctttgagccagagctcccttctgatagcttagctgttgcaagaactaagcaaaatgatggactaaaatcgcccattgatagacgaccttctatgaagcttccagccattagaagcgtgtctaaatcatctcaaggtaaggcacagcgacctttactaaatcccgagaagagaacagctaaccacggctgtgggagtgggcgacggccatcagcagaaaagatttcatggaacgtgcttgatctcaagggagataattacttctcctgtgctgttggtcgaactcgcacaaatgctcgctatctacttggatcatcagatgatgtcgtgtccttcctaatgaaattagccaatgcatctacgtga

SEQ ID NO: 287 - protein, 922 aa, Populus tremuloides
MPGNQYNGNSTLNSGRVGRLLKIREQRRSIRSAYSNEVTDNHRGTEACENDLRTREGDSLNNSFIEQYLEGAIAEGYEKLDVRPLRQRLLVVANRLPVSAVRRGEDSWSLEISAGGLVTALLGVKEFEAKWIGWAGVNVPDEVGQKALTEALAEKRCIPVFLDEEIVHQYYNGYCNNILWPLFHYLGLPQEDRLATTRSFQSQFAAYKKANQMFADVVNQHYEEGDVVWCHDYHLMYLPKCLKEYNNNMKVGWFLHTPFPSSEIHRTLPSRSDLLRSVLAADLVGFHTYDYARHFVSACTRILGLEGTPEGVEDQGRLTRVAAFPIGIDSDRFIRALELPQVQEHIKELKERFAGRKVMLGVDRLDMIKGIPQKILAFEKFLEENSAWRDKVVLLQIAVPTRTDVPEYQKLTSQVHEIVGRINGRFGTLTAVPIHHLDRSLDFHALCALYAVTDVALVTSLRDGMNLVSYEFVACQDSKKGVLILSEFAGAAQSLGAGAILVNPWNITEVADSIRQALTMSPEEREKRHRHNFVHVTTHTAQEWAETFVSELDDTVIEAQLRTKQVPPALPEEDAISRYLQSTNRLLILGFNATLTEPADTPGRRADQIKEMELKLHPELKEALTALCSDRKTTIVVLSGSDRKTLDDNFGEYDMWLAAEHGMFLRLTKGEWMTTMPEHLNMEWVDSVKHVFEYFTERTPRSHFERCETSLVWNYKYADVEFGRLQARDMLQHLWTGPISNASVDVVQGNRSVEVRAVGVTKGAAIDRILGEIVHSKSMTTPIDYVLCIGHFLGKDEDVYTFFEPELPSDSLAVARTKQNDGLKSPIDRRPSMKLPAIRSVSKSSQGKAQRPLLNPEKRTANHGCGSGRRPSAEKISWNVLDLKGDNYFSCAVGRTRTNARYLLGSSDDVVSFLMKLANAST

SEQ ID NO: 288 - DNA, 2934 bp, Sorghum bicolor
atgagctctgacgccgcggggggacagcgcagcatcagcaactccacgaggggcgacgcggcggcggcgatgccaacctcatcgccctttgtcgtcggcgacagcagcggcggcgcgggctccccgatccgcgtcgaccgaatggtccgggagcacggccgccgctacgacatcttcgcgtcggacgcgatggataccgacggcgccgagccggcgtcggcttccgcggggcccttcgccgtggatggggtccagtcgcctggccgtgtgtcacccgccaacatggaggatgccggcggcgcggccgctgggcacgccgcgcgaccgccgctcgccggctcccgcagcggtttccgccgcctcggcctccgtggcatgaagcagcgcctcctcgtcgtggccaaccgcctccctgtttccgccaaccgccgcggcgaggaccactggtcgcttgagatcagcgccggcggcctcgtgagcgccctgcttggggtgaaggacgtcgacgcgaaatggattggctgggcgggcgtcaacgttccagacgaggttggccagcgagccctcaccaaagctcttgccgagaagagatgcataccagtgttcctggatgaggagattgtgcaccagtactacaatgggtattgcaacaacatcctgtggccgctgttccactacctaggactaccacaggaggacaggctggcaacaacgaggaactttgagtcacagttcgacgcgtacaagcgtgctaaccagatgtttgctgatgtcgtgtaccagcactaccaggagggggatgtaatctggtgccatgactaccacctcatgttcctgcccaagtgcctcaaggaccatgacatcaatatgaaagtcggttggttcctgcacacgccattcccatcatcagagatttaccgaacactgccatcccgcttggagctgcttcgctcggtgctgtgtgctgatttagtcggatttcatacttacgactatgcgaggcattttgtgagtgcttgcactagaatacttggacttgagggtacccctgagggtgtggaagatcaaggaagactaaccagggttgcagcgtttcctattgggatagactctgatcgtttcaagcgagcattggagcttccagcagtaaaaaggcacatcagtgaattgacacaacgttttgctggtcgaaaggtaatgcttggtgttgatcgacttgacatgattaagggaattccacaaaagattttggcctttgaaaagtttcttgaggaaaacccagactggaacgacaaagttgttctactgcagattgctgtgccaacaagaactgacgtccctgagtatcaaaagctaacaagccaagtgcatgaaattgttgggcgcataaacggtcgattcggaacgttgactgctgtccctattcatcatctggaccgatctcttgatttccatgctttgtgtgctctttatgcagtcactgatgttgctcttgtaacatcactgagagatgggatgaaccttgtgagctatgagtatgttgcatgccaagggtctaagaaaggagttttgatacttagtgagtttgctggggcagcacaatcacttggagctggcgccattctagtaaacccttggaatattacagaagttgcagactcaatacggcacgctttgacgatgccatccgatgagagagagaaacggcacaggcacaactatgctcatgtcacaactcacacggctcaagattgggctgaaacttttgtatttgagctaaatgacacggttgctgaagcactactgaggacaagacaagttcctcctggacttcctagtcaaacggcaatccagcaatatttgcgctctaaaaatcgtctgctcatattgggtttcaattcaacattgactgaaccagtcgaatcctctgggagaaggggtggtgaccaaatcaaggaaatggaactcaagttgcatcctgacttaaagggtcctctgagagccctctgtgaagatgagcgcactacagttattgttcttagtggcagtgacaggagtgttcttgatgaaaatttcggagaatttaaaatgtggttggcagcagagcatgggatgtttttacgcccgacttatggagaatggatgacaacaatgcctgagcatctgaacatggattgggttgacagcgtaaagcatgtttttgaatactttacagaaagaaccccaagatcccatttcgaacatcgtgaaacatcatttgtgtggaactacaagtatgctgatgttgaatttggaaggctacaagcaagagatatgctgcagcacttgtggacaggtccgatctcaaatgcagctgttgatgttgttcaagggagtcggtcagttgaagttcggtctgttggagttacaaagggtgctgcaattgatcgcattttaggggagatagttcacagcgaaaacatggttactccaattgactatgtcctgtgtatagggcatttccttgggaaggatgaggatatctatgtcttttttgatcccgagtacccttctgaatccaaaataaaaccagagggtggctcagcttcacttgaccggaggcccaacggaaggccaccatcgaacggcaggagcaactccaggaacccacagtccaggacacagaaggcgcagcaggctcaggctgcatccgagaggtcatcctcttcaagccacagcagcgcaagcagcaaccatgactggcgcgaagggtcctcggtccttgatctcaagggcgagaactacttctcctgcgccgttggaaggaaacggtccaacgcccgctacctgctgagttcgtcagaggaggttgtctccttcctcaaggagctggcaacagcaacagctggcttccaatccagctgtgctgattacatgttcctggataggcagtaa

SEQ ID NO: 289 - protein, 977 aa, Sorghum bicolor
MSSDAAGGQRSISNSTRGDAAAAMPTSSPFVVGDSSGGAGSPIRVDRMVREHGRRYDIFASDAMDTDGAEPASASAGPFAVDGVQSPGRVSPANMEDAGGAAAGHAARPPLAGSRSGFRRLGLRGMKQRLLVVANRLPVSANRRGEDHWSLEISAGGLVSALLGVKDVDAKWIGWAGVNVPDEVGQRALTKALAEKRCIPVFLDEEIVHQYYNGYCNNILWPLFHYLGLPQEDRLATTRNFESQFDAYKRANQMFADVVYQHYQEGDVIWCHDYHLMFLPKCLKDHDINMKVGWFLHTPFPSSEIYRTLPSRLELLRSVLCADLVGFHTYDYARHFVSACTRILGLEGTPEGVEDQGRLTRVAAFPIGIDSDRFKRALELPAVKRHISELTQRFAGRKVMLGVDRLDMIKGIPQKILAFEKFLEENPDWNDKVVLLQIAVPTRTDVPEYQKLTSQVHEIVGRINGRFGTLTAVPIHHLDRSLDFHALCALYAVTDVALVTSLRDGMNLVSYEYVACQGSKKGVLILSEFAGAAQSLGAGAILVNPWNITEVADSIRHALTMPSDEREKRHRHNYAHVTTHTAQDWAETFVFELNDTVAEALLRTRQVPPGLPSQTAIQQYLRSKNRLLILGFNSTLTEPVESSGRRGGDQIKEMELKLHPDLKGPLRALCEDERTTVIVLSGSDRSVLDENFGEFKMWLAAEHGMFLRPTYGEWMTTMPEHLNMDWVDSVKHVFEYFTERTPRSHFEHRETSFVWNYKYADVEFGRLQARDMLQHLWTGPISNAAVDVVQGSRSVEVRSVGVTKGAAIDRILGEIVHSENMVTPIDYVLCIGHFLGKDEDIYVFFDPEYPSESKIKPEGGSASLDRRPNGRPPSNGRSNSRNPQSRTQKAQQAQAASERSSSSSHSSASSNHDWREGSSVLDLKGENYFSCAVGRKRSNARYLLSSSEEVVSFLKELATATAGFQSSCADYMFLDRQ

SEQ ID NO: 290 - DNA, 2985 bp, Selaginella lepidophylla
atgcctcagccttacccttcttcctcatccacaagcaatgccaaggaggcaggaggaggcgctgcggcggcggggggcggcggcggcggcgccttcagcttgccgccgtcgctagcatcatcgcgagtggagcgcctggtgcgtgagaggcagctgcggaatcaaaggcaggaggatgaacctgaggatgagcagcaggcgctggaggcggaggaagcggcggtggcggctaccgaggtgcccgatgccgtcgccgctgccacgccatcgctctccgatgagccgtccaagatttccagcggtcgaggccagcggttgcttgtggttgccaatcgccttcccttgtctgccacgaggaaaggcgagacggaatggaatttggagatgagcgccgggggccttgtaagtgcgcttttgggcgtcaagcagtttgaagtcacctggatcggatggcctggtgtctatgtacaagacgagaagggtgagaaatcgctgcgaggagctcttgaagaaaagggatttgtgcccgttcttctcgacgaggcaactgttgatcagtactacaatggctattgcaacaacgtgctttggccgcttttccactacattggtcttaggcaggaagaccggctggctgccacgcgcagcttactatcccagtttaacgcatataaacgtgctaatcgtttgtttgcggaggctgtgttcaatttctaccaggaaggggatgtggtgtggtgccacgattaccatcttatgttcctccccagctacctcaaggagaaggacagccagatgaaagtcgggtggttcctccacacgccgttcccctcgtctgagatttacagaacgctgccgctgcgggccgagctgctccaaggcgtcttagctgcggatttggtggggttccacacatacgactatgcaaggcactttgttagcgcgtgcacacggatactcgggctggaaggcactcccgagggtgtcgaggatcaagggaagaacacgcgagtggctgccttccccgtggggatcgactcggagcgatttatcgaggccgtagaaactgatgcggtcaagaaacacatgcaagagctgagccagcgttttgctggtcgtaaggttatgttgggggtggataggcttgacatgattaaaggaattccacagaagctgctagcctttgaaaaattcctcgaggagaactccgagtggcgtgataaggtcgtcctggtgcaaatcgcggtgccgactagaacggacgtcctcgagtaccaaaagcttacgagccaggttcacgagattgttggtcgcataaatggacgtttcggctccttgacggctgttcctatccatcacctcgatcgctccatgaaatttccggagctttgtgccttatatgcaatcactgatgtcctgctcgtgacatccctgcgtgatggcatgaacctcgtgagctacgagttcgttgcttgccaaaaggataagaagggcgcgcttattctgagtgagtttgcaggcgctgcgcagtctctgggtgcggggtctatcctcataaatccgtggaatataatagagtcgtccaacgccattgcggacgctctcaacatgccagaagaagaacgggaagaacggcatcgtcataacttcatgcacataactactcacagtgctcaagtatgggcggagacgtttatcagcgaactcaatgattccatcttggaagccgagctgcgcactctgcatattccgcctcaattgcctttggataaagcagtcgcaaagtactcggagtcaaagaaccggctagtaattttgggcttcaactcgactttgaccgcgcaagtggaagctccgagaggtagggcgcccgaccagatcagggagatgaagatacgtcttcatcctagcataaaggacatcctcaatgtactttgctctgatccaaagacgacaatagtcatcctaagcgggagcgagcgcgtggctcttgacgaggtatttggagagttcgatttgtggctggcggcggaaaacgggatgtttcttcgtcatactcaaggggagtggatgacaacaatgcccgaacatctgaacatggattggttggaaagtgtacagttggtctttgattatttttgtgagaggacgccacgctcttttgtcgagacccgtgagacgtctctggtgtggaactataagtatgcagatgttgaattcggcagggtgcaggcacgtgatatgctacagcacctgtggaccgggcccatatccaacgctgccgtcgacgtcgtgcaaggcggaaagtcggtcgaggtccgccccgtaggagtctcgaaggggtctgcaattgaccggattctaggcgaaatcgtgcacagcaaacacatgacgatacccatcgactacgtcctttgcataggacactttttgagcaaggacgaggatatctacacattcttcgaaccggagctgccactgctggacagggactcgtcgacgagcaacggagggaaaccactgggtggaaagcttccaatagaccgaaagtcttcaaagagctcctctcgcatgaagccgccagtgtcgtcaccaaagtcacccggccgtggaagcgagcagcagcagcaagctgaggaggcaagcagatgggaaggatcgtccgtgctggatctccagggagagaactacttcagctgtgcagtgggaaccatgaagaggtcactagctcgctactgcctcacttcttcagaggaggtggtgacattcctgacctcgctcacaagcacagtggcagcagcagcaggggcaggagcaggagcaagagcgacgggatcaggagcagcaggagcaggagcaggagcaggagcaggtggggatcatgaagctccaggatcaccaatcaggaaaagcgattcgttcaagacgagcgggtggcatagtccaacgccccgctctccaaagctcgctccagcggtacagtga

SEQ ID NO: 291 - protein, 994 aa, Selaginella lepidophylla
MPQPYPSSSSTSNAKEAGGGAAAAGGGGGGAFSLPPSLASSRVERLVRERQLRNQRQEDEPEDEQQALEAEEAAVAATEVPDAVAAATPSLSDEPSKISSGRGQRLLVVANRLPLSATRKGETEWNLEMSAGGLVSALLGVKQFEVTWIGWPGVYVQDEKGEKSLRGALEEKGFVPVLLDEATVDQYYNGYCNNVLWPLFHYIGLRQEDRLAATRSLLSQFNAYKRANRLFAEAVFNFYQEGDVVWCHDYHLMFLPSYLKEKDSQMKVGWFLHTPFPSSEIYRTLPLRAELLQGVLAADLVGFHTYDYARHFVSACTRILGLEGTPEGVEDQGKNTRVAAFPVGIDSERFIEAVETDAVKKHMQELSQRFAGRKVMLGVDRLDMIKGIPQKLLAFEKFLEENSEWRDKVVLVQIAVPTRTDVLEYQKLTSQVHEIVGRINGRFGSLTAVPIHHLDRSMKFPELCALYAITDVLLVTSLRDGMNLVSYEFVACQKDKKGALILSEFAGAAQSLGAGSILINPWNIIESSNAIADALNMPEEEREERHRHNFMHITTHSAQVWAETFISELNDSILEAELRTLHIPPQLPLDKAVAKYSESKNRLVILGFNSTLTAQVEAPRGRAPDQIREMKIRLHPSIKDILNVLCSDPKTTIVILSGSERVALDEVFGEFDLWLAAENGMFLRHTQGEWMTTMPEHLNMDWLESVQLVFDYFCERTPRSFVETRETSLVWNYKYADVEFGRVQARDMLQHLWTGPISNAAVDVVQGGKSVEVRPVGVSKGSAIDRILGEIVHSKHMTIPIDYVLCIGHFLSKDEDIYTFFEPELPLLDRDSSTSNGGKPLGGKLPIDRKSSKSSSRMKPPVSSPKSPGRGSEQQQQAEEASRWEGSSVLDLQGENYFSCAVGTMKRSLARYCLTSSEEVVTFLTSLTSTVAAAAGAGAGARATGSGAAGAGAGAGAGGDHEAPGSPIRKSDSFKTSGWHSPTPRSPKLAPAVQ

SEQ ID NO: 292 - DNA, 2781 bp, Solanum lycopersicum
atgccagggaacaagtataccggcaaccaagcggttgctagcactcgattggagaggctattgagagaaagagagcttaggaaaagtagcaaagtttctcactttccaaatgaatctactgataacaataggggaaacgagctctctgaccatgattttcgccaaggagaagctgataatggaggagtttcatatgtcgaacagtacctcgaaggagctgcactagcatataatgaaggatgggagcggcctgatggaaagcccaccagacaacgactcttggttgtggcaaacaggttacctgtctctgcagtaaggagaggcgaggaatcctggtctctagagataagtggtggaggtcttgttagtgctcttcttggtgtgaaggagtttgaggctagatggattggttgggcaggtgtgaatgtgccagatgaggctgggcagagggcacttactaaggcactggcagaaaagaggtgtatccctgtattcctggatgaagaaattgttcatcagtattacaacggttactgcaacaatatattgtggcctcttttccattatcttggacttccgcaagaagaccgccttgcgactaccagaagtttccagtctcagtttgctgcttataagaaagcaaatcaaatgtttgctgatgttgtgaatgaacattacgaagaaggtgatgtggtatggtgtcatgactaccatctcatgttcctgccaaaatgtctcaaggattacaacagccaaatgaaagtcggttggtttctacacacaccctttccatcctcggaaatacacaggacactgccgtctagatcagagctgctccgagcagttcttgctgctgacttggttggttttcatacctatgactatgcaaggcattttgttagtgcatgtactcgtatcctgggacttgaaggaacacctgaaggagtagaagatcaaggtagactgacccgcgttgctgcgtttcctattggtatagattcagaacgatttattcgagcacttgaagttactcaagttcaggaacacataaaagaactaaaagagagatttgctgggagaaaggttatgctaggagttgatcgccttgatatgattaaaggaattccccaaaagatcctggcatttgagaagttccttgaagaaaatccgtactggcgtgataaagtggttttgcttcaaattgctgtgccaacaagaacagatgttcctgaataccaaaaacttaccagtcaagttcatgagattgttggacgcatcaatggtcggtttggaactttgactgcagtgcctattcatcatctggaccgttctcttgactttcatgcattatgtgcactgtatgctgtaactgatgtagcgttggttacctctttaagagatggcatgaacctcgtcagctatgaatttgtagcctgccaagagttgaaaaaaggggtccttattctcagcgaatttgctggtgctgcacaatcgttaggtgctggagcaattctggtgaatccatggaatataacagaggttgctgcttcgattgggcaagctttaaatatgtcagctgaagaaagagaaaaacgccacaggcataactttctgcatgtgactacgcatactgctcaagaatgggctgagacttttgtgagtgaactaaatgatactgttattgaagctcaacagaggataagaaaagttccgccccggcttaacatcagtgatgcaattgagcgctattcgttttccaataatcgactactaatattgggtttcaattctacactgacagaatcggtggatacccctggaagaagaggtggagatcaaatcaaagaaatggaactgaaattgcatcctgagttgaaagaatcattgctcgcgatttgtaacgacccaaagacaacagtcgttgtcctcagtggaagtgatagaaacgtcttagatgataacttcagcgagtacaacatgtggttagcagcagaaaatggaatgtttttacgatctacaaacggtgtatggatgacaactatgccagaacacctaaacatggactgggttgatagtgttaagcacgttttcgagtacttcactgaaaggacaccgagatctcactttgaacaacgtgaaacttcacttgtttggaattacaagtatgcagatgttgaatttggaagattgcaagctagagacatgcttcagcatctctggacaggtccaatatcaaatgcatctgttgatgttgtacaaggactccgctccgttgaggttcgagcagttggtgttacaaagggagcagcaatagatcgtatactgggggagatcgtacacagtaaagccatcgcaacaccaattgattacgttttatgcatagggcattttctggggaaggatgaggatgtatatacattttttgagccagagcttccttctgactgcatcggtatgccaagaagtaaggtcagtgatgcaccaaaggtgcccggggaaaggcgatcagttccaaaactcccttctagtcgaactagctcaaagtcatctcagaataggaacagaccagtttcaaactcggataagaagacttccaatgggcgacggccctcacctgaaaatgtgtcatggaatgtgctggatctgaagaaggagaattacttctcttgtgcagttggaaggactcgtacaaacgctcggtatctgctcagtacgccagacgacgttgttgcttttctaagggaactagctgaagcacctatttcaaatgggacatcatga

SEQ ID NO: 293 - protein, 926 aa, Solanum lycopersicum
MPGNKYTGNQAVASTRLERLLRERELRKSSKVSHFPNESTDNNRGNELSDHDFRQGEADNGGVSYVEQYLEGAALAYNEGWERPDGKPTRQRLLVVANRLPVSAVRRGEESWSLEISGGGLVSALLGVKEFEARWIGWAGVNVPDEAGQRALTKALAEKRCIPVFLDEEIVHQYYNGYCNNILWPLFHYLGLPQEDRLATTRSFQSQFAAYKKANQMFADVVNEHYEEGDVVWCHDYHLMFLPKCLKDYNSQMKVGWFLHTPFPSSEIHRTLPSRSELLRAVLAADLVGFHTYDYARHFVSACTRILGLEGTPEGVEDQGRLTRVAAFPIGIDSERFIRALEVTQVQEHIKELKERFAGRKVMLGVDRLDMIKGIPQKILAFEKFLEENPYWRDKVVLLQIAVPTRTDVPEYQKLTSQVHEIVGRINGRFGTLTAVPIHHLDRSLDFHALCALYAVTDVALVTSLRDGMNLVSYEFVACQELKKGVLILSEFAGAAQSLGAGAILVNPWNITEVAASIGQALNMSAEEREKRHRHNFLHVTTHTAQEWAETFVSELNDTVIEAQQRIRKVPPRLNISDAIERYSFSNNRLLILGFNSTLTESVDTPGRRGGDQIKEMELKLHPELKESLLAICNDPKTTVVVLSGSDRNVLDDNFSEYNMWLAAENGMFLRSTNGVWMTTMPEHLNMDWVDSVKHVFEYFTERTPRSHFEQRETSLVWNYKYADVEFGRLQARDMLQHLWTGPISNASVDVVQGLRSVEVRAVGVTKGAAIDRILGEIVHSKAIATPIDYVLCIGHFLGKDEDVYTFFEPELPSDCIGMPRSKVSDAPKVPGERRSVPKLPSSRTSSKSSQNRNRPVSNSDKKTSNGRRPSPENVSWNVLDLKKENYFSCAVGRTRTNARYLLSTPDDVVAFLRELAEAPISNGTS

SEQ ID NO: 294 - DNA, 2580 bp, Triticum aestivum
atgaagcagcgcctcctcgtcgtggccaaccgcctccccgtctccgccaatcgccgcggcgaggatcagtggtccctggagatcagcgccggtggcctcgtcagcgcgctcctcggtgtgaaagatgtcgacgcgaagtggatcggctgggccggtgtgaatgtccccgacgaggtcggccagcaggctctcaccaatgcactcgccgagaagagatgcataccagtcttcctggacgaggagatcgtgcaccagtactacaacggctactgcaacaacatactgtggccgctcttccactacctcgggctgccgcaggaggacaggctggcaaccacccggaacttcgagtcgcagttcgacgcgtacaagcgggccaaccagatgtttgctgatgtcgtctaccagcactaccaggaaggggatgtgatctggtgccatgactaccacctcatgttcctgcccaggtgcctcaaggagcatgacatcaacatgaaggtcgggtggttcctgcacacgcccttcccttcctcggagatttaccgcactctgccatcacgctcggagctgcttcgctccgtgctctgcgctgatttagtcggatttcatacatacgactatgcaaggcatttcgtgagcgcatgtaccagaatactcggactcgagggtacccctgaaggtgtggaggaccagggaaagttaacgcgggttgcagcgtttcctattgggatagactctgatcgtttcaaaagggcgttggacattgacgcagcaaaaagacatgtcaatgaactgaaacagcgatttgcgggacggaaggtaatgcttggtgttgatcgacttgacatgatcaaaggaattccccaaaagattttggcctttgaaaagtttcttgaggaaaaccctgaatggattgataaagtggttctacttcaaattgctgtgccaactagaactgacgtccctgagtatcagaagcttacaagccaagtgcatgaaattgttgggcgcataaatggacgatttggaacattgtctgctgttcctattcatcatctggatcgatctcttgatttccatgccttgtgtgctctttatgcagtcactgatgtggctcttgtaacatcactgagggatggcatgaatcttgtaagctacgaatatgttgcatgccagggatcaaaaaaaggagttctgatattgagtgagtttgccggtgcagcacaatcgcttggtgctggtgccattcttgtaaatccctggaatattacagaagttgcagactcaataaaacatgctttgacaatgacatctgatgagagagagaagcggcacaggcataactacgcgcatgtaacaactcataccgcccaagattgggctgaaacttttgtatgtgagctaaacgatacagttgctgaagctctgatgagaacaagacaagttccccctgaccttcctagtcgaacggccatccagcaatatctgcagtcaaaaaaccgtttgctcatattgggtttcaattcaacattgaccgagccagttgaatcctctgggagacggggcggtgatcaagtcaaggagatggaactcaagttgcatcctgacttaaagggtcctttgagagccctctgcgaggacgagagcactacggttatcgttctcagcggaagcgacaggagtgttcttgatgaaaatttcggagaatttaacttgtggctggcagcagagcatgggatgttcttacgcccaactgatggagaatggatgacaacaatgcctgagcatctgaacatggattgggtcgacagtgcaaagcatgtttttgagtacttcacagaaagaaccccaagatctcattttgaacatcgtgaaacatcatttgtgtggaattacaagtatgccgatgttgagtttgggaggctccaagcaagagatatgctgcagcacttgtggaccggtccaatctcaaatgcagctgtggatgttgttcaagggagccgttcagttgaagttcgctctgttggagttacaaagggtgctgcaattgatcgtattctaggagagatagttcacagcaaaagcatggttactccgattgactatgtgctatgcataggccacttcctaggaaaggacgaagacatctatgtgttttttgaccctgaatacccttctgagccaaaagtgaaaccggacggtgcgtcggtatccgtcgacaggaggcagaacgggcggccatcaaacggccggagcaactcgaggaactcgcaggcgaggacacaaaagcctcaggtcgcgccgccgcctccggagaggtcatcgtcgtcatccgaccacagcaccgcaaacaacaacagccaccacgactggcgcgaagggtcgtcggtcctcgacctcaacggcgacaactacttctcctgcgcggtcgggaggaagcgctccaacgcccgttacctgctcaactcgtcggaggacgtcgtctcattccttaaggagatggcggagtcgacgacgccccgcgccggtggcctcccgcccggcgctgccgcggactacatgttcttggataggcagtag

SEQ ID NO: 295 - protein, 859 aa, Triticum aestivum
MKQRLLVVANRLPVSANRRGEDQWSLEISAGGLVSALLGVKDVDAKWIGWAGVNVPDEVGQQALTNALAEKRCIPVFLDEEIVHQYYNGYCNNILWPLFHYLGLPQEDRLATTRNFESQFDAYKRANQMFADVVYQHYQEGDVIWCHDYHLMFLPRCLKEHDINMKVGWFLHTPFPSSEIYRTLPSRSELLRSVLCADLVGFHTYDYARHFVSACTRILGLEGTPEGVEDQGKLTRVAAFPIGIDSDRFKRALDIDAAKRHVNELKQRFAGRKVMLGVDRLDMIKGIPQKILAFEKFLEENPEWIDKVVLLQIAVPTRTDVPEYQKLTSQVHEIVGRINGRFGTLSAVPIHHLDRSLDFHALCALYAVTDVALVTSLRDGMNLVSYEYVACQGSKKGVLILSEFAGAAQSLGAGAILVNPWNITEVADSIKHALTMTSDEREKRHRHNYAHVTTHTAQDWAETFVCELNDTVAEALMRTRQVPPDLPSRTAIQQYLQSKNRLLILGFNSTLTEPVESSGRRGGDQVKEMELKLHPDLKGPLRALCEDESTTVIVLSGSDRSVLDENFGEFNLWLAAEHGMFLRPTDGEWMTTMPEHLNMDWVDSAKHVFEYFTERTPRSHFEHRETSFVWNYKYADVEFGRLQARDMLQHLWTGPISNAAVDVVQGSRSVEVRSVGVTKGAAIDRILGEIVHSKSMVTPIDYVLCIGHFLGKDEDIYVFFDPEYPSEPKVKPDGASVSVDRRQNGRPSNGRSNSRNSQARTQKPQVAPPPPERSSSSSDHSTANNNSHHDWREGSSVLDLNGDNYFSCAVGRKRSNARYLLNSSEDVVSFLKEMAESTTPRAGGLPPGAAADYMFLDRQ

SEQ ID NO: 296 - protein, 474 aa, Escherichia coli
MSRLVVVSNRIAPPDEHAASAGGLAVGILGALKAAGGLWFGWSGETGNEDQPLKKVKKGNITWASFNLSEQDLDEYYNQFSNAVLWPAFHYRLDLVQFQRPAWDGYLRVNALLADKLLPLLQDDDIIWIHDYHLLPFAHELRKRGVNNRIGFFLHIPFPTPEIFNALPTYDTLLEQLCDYDLLGFQTENDRLAFLDCLSNLTRVTTRSAKSHTAWGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLMKIFRYSDVGLVTPLRDGMNLVAKEYVAAQDPANPGVLVLSQFAGAANELTSALIVNPYDRDEVAAALDRALTMSLAERISRHAEMLDVIVKNDINHWQECFISDLKQIVPRSAESQQRDKVATFPKLA

SEQ ID NO: 297 - protein, 495 aa, Saccharomyces cerevisiae
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 298 - DNA, 1134 bp, Arabidopsis thaliana
ggccggccaatgactaaccagaatgtcatcgtttccgacaggaaacccatcttgggtttgaaaaccatcactgtctctgtctctaactctcctctgttctctaattcctttcccacttactttaacttccctcgtcgaaagctcttgaaacttcttgaagcagccgacaaaaacaacttagttgttgctccaaagattacgtctatgatcgattccatgcgtgattcttcccctacacgtctcagatcctcttcctatgactctgtttcagataacgacgacaaaacatcttggatcgttcgttttccttcggctttaaatatgtttgatgagattgtgaatgctgcgaaagggaaacagattgtcatgtttcttgattacgacggaactctttctcccatagttgaagatcccgacaaagctttcataacccatgagatgagagaagtcgtaaaagacgtggcttcgaatttcccgactgctattgtcaccgggagatccattgagaaggttcgtagttttgtccaagtaaacgagatttactacgccggaagccacggcatggacattgaaggtccgaccaacgaaaatagtaacggccagagtaatgaaagagtgctattccaacctgctcgtgaatttttaccgatgatcgagaaggtggttaatattttagaggaaaaaacaaaatggatccctggggctatggtggagaacaacaagttttgtctgtccgtacattttcgacgtgttgatgagaagagatggcctgcattagctgaagtagtaaaatcagttcttattgattatccaaagctgaaactaacccaaggtagaaaggtacttgaaatccgccccacaatcaaatgggacaagggccaggcactcaattttttactaaaatcattaggatatgaaaattcggatgatgttgtgccggtgtatatcggggatgaccgtactgacgaagatgcgtttaaggttctacgtgaaaggggacaaggttttgggattcttgtctcaaaagtaccaaaggacaccaatgcctcttattctcttcaagacccttctcaggttaacaagtttctggaacgtttagtagaatggaagaggaagacagtgggagaagagtga

SEQ ID NO: 299 - protein, 377 aa, Arabidopsis thaliana
GRPMTNQNVIVSDRKPILGLKTITVSVSNSPLFSNSFPTYFNFPRRKLLKLLEAADKNNLVVAPKITSMIDSMRDSSPTRLRSSSYDSVSDNDDKTSWIVRFPSALNMFDEIVNAAKGKQIVMFLDYDGTLSPIVEDPDKAFITHEMREVVKDVASNFPTAIVTGRSIEKVRSFVQVNEIYYAGSHGMDIEGPTNENSNGQSNERVLFQPAREFLPMIEKVVNILEEKTKWIPGAMVENNKFCLSVHFRRVDEKRWPALAEVVKSVLIDYPKLKLTQGRKVLEIRPTIKWDKGQALNFLLKSLGYENSDDVVPVYIGDDRTDEDAFKVLRERGQGFGILVSKVPKDTNASYSLQDPSQVNKFLERLVEWKRKTVGEE

SEQ ID NO: 300 - DNA, 1125 bp, Arabidopsis thaliana
atgactaaccagaatgtcatcgtttccgacaggaaacccatcttgggtttgaaaaccatcactgtctctgtctctaactctcctctgttctctaattcctttcccacttactttaacttccctcgtcgaaagctcttgaaacttcttgaagcagccgacaaaaacaacttagttgttgctccaaagattacgtctatgatcgattccatgcgtgattcttcccctacacgtctcagatcctcttcctatgactctgtttcagataacgacgacaaaacatcttggatcgttcgttttccttcggctttaaatatgtttgatgagattgtgaatgctgcgaaagggaaacagattgtcatgtttcttgattacgacggaactctttctcccatagttgaagatcccgacaaagctttcataacccatgagatgagagaagtcgtaaaagacgtggcttcgaatttcccgactgctattgtcaccgggagatccattgagaaggttcgtagttttgtccaagtaaacgagatttactacgccggaagccacggcatggacattgaaggtccgaccaacgaaaatagtaacggccagagtaatgaaagagtgctattccaacctgctcgtgaatttttaccgatgatcgagaaggtggttaatattttagaggaaaaaacaaaatggatccctggggctatggtggagaacaacaagttttgtctgtccgtacattttcgacgtgttgatgagaagagatggcctgcattagctgaagtagtaaaatcagttcttattgattatccaaagctgaaactaacccaaggtagaaaggtacttgaaatccgccccacaatcaaatgggacaagggccaggcactcaattttttactaaaatcattaggatatgaaaattcggatgatgttgtgccggtgtatatcggggatgaccgtactgacgaagatgcgtttaaggttttacgtgaaaggggacaaggttttgggattcttgtctcaaaagtaccaaaggacaccaatgcctcttattctcttcaagacccttctcaggttaacaagtttctggaacgtttagtagaatggaagaggaagacagtgggagaagagtga

SEQ ID NO: 301 - protein, 374 aa, Arabidopsis thaliana
MTNQNVIVSDRKPILGLKTITVSVSNSPLFSNSFPTYFNFPRRKLLKLLEAADKNNLVVAPKITSMIDSMRDSSPTRLRSSSYDSVSDNDDKTSWIVRFPSALNMFDEIVNAAKGKQIVMFLDYDGTLSPIVEDPDKAFITHEMREVVKDVASNFPTAIVTGRSIEKVRSFVQVNEIYYAGSHGMDIEGPTNENSNGQSNERVLFQPAREFLPMIEKVVNILEEKTKWIPGAMVENNKFCLSVHFRRVDEKRWPALAEVVKSVLIDYPKLKLTQGRKVLEIRPTIKWDKGQALNFLLKSLGYENSDDVVPVYIGDDRTDEDAFKVLRERGQGFGILVSKVPKDTNASYSLQDPSQVNKFLERLVEWKRKTVGEE

SEQ ID NO: 302 - DNA, 963 bp, Arabidopsis thaliana
atgaagattacggatatttccggaaagatcgagactttggttgattccttaagggatatgtccccgacccgtgtcagatcttccttctctgatgaacatgtatccgagaacgatgacgagagaagctcctggattgctcttcatccgtcagcattggatatgttcgaacaaatcatgcgtgatgctgaaggcaaacaaattattatgtttcttgattacgacggaactctctcgctaatcactgaagatcacgacagagcctacataaccgacgagatgcgagaagttgtaaaggaagtggctacatatttcaagacagcgatcatcagcggacgaagcactgacaaagtacagagttttgtgaaactcactggtattcactacgctgggagccacggcatggacattaagggtccgacaaataccgatcagagtaaccaagaagaagtgatgtttcaacctgcaagtgactatttaccgatgattgacgaggtggttaatgttttgaaggaaaagacaaaatctatccctggagctacggtcgagcacaacaagttttgtctaacagtacattttcgtcgggtcgatgaaacgggatgggctgcattagctgagcaagtgagattggttctcattgattatccgaaattgagactgacacaaggcagaaaggtcttagaactccgaccttccatcaaatgggacaagggaaaggctctcgaatttttgctaaactcattagggatagcagaatctaaagatgttttaccggtttacattggagatgaccgtactgatgaagatgcatttaaggttttatgtgaaaggggacaaggttttgggattatcgtctcaaaaactattaaggaaacgtacgcctcttactctcttcaagacccatctcaggttaaagaatttctggagcgtttggtaaagtggaagaaacaaacacttggagaataa

SEQ ID NO: 303 - protein, 320 aa, Arabidopsis thaliana
MKITDISGKIETLVDSLRDMSPTRVRSSFSDEHVSENDDERSSWIALHPSALDMFEQIMRDAEGKQIIMFLDYDGTLSLITEDHDRAYITDEMREVVKEVATYFKTAIISGRSTDKVQSFVKLTGIHYAGSHGMDIKGPTNTDQSNQEEVMFQPASDYLPMIDEVVNVLKEKTKSIPGATVEHNKFCLTVHFRRVDETGWAALAEQVRLVLIDYPKLRLTQGRKVLELRPSIKWDKGKALEFLLNSLGIAESKDVLPVYIGDDRTDEDAFKVLCERGQGFGIIVSKTIKETYASYSLQDPSQVKEFLERLVKWKKQTLGE

SEQ ID NO: 304 - DNA, 1110 bp, Arabidopsis thaliana
atgacaaaccataatgccttaatctctgatgctaaaggcagcatcggagttgcggttagagttccaaaccaatctctgttttctcccggaggtggccgatacatcagcattccccggaagaaactcgtgcagaagctagaggccgacccgagtcaaacccgtatccacacttggatcgaagccatgagggcttcttccccaacccgtacccgaccggggaacatatctcccctcccggagtccgatgaggaggatgaatactcttcttggatggctcaacacccgtcagctttaaccatgtttgaagagatagctgaagcttcaaaagggaaacaaatcgtgatgtttctcgactatgacggtacattatcccccattgttgaaaaccctgatcgagcttacatgtctgaagagatgagagaggcagtgaaaggcgtggctagatatttcccgaccgcgattgtcactggaagatgccgtgataaggttcgtagatttgtgaaacttcccggactttactatgcaggtagccatggaatggacatcaaaggaccttccaaaagaaacaaacataacaagaacaataaaggagttcttttccaagcggcgaatgagtttttgcctatgattgacaaggtctctaagtgtctagtagagaaaatgagagacatagaaggagcaaacgtcgagaacaacaagttttgtgtctccgtacattaccgttgtgttgatcaaaaggactggggattggtagcggaacacgtgacatcgatattgagtgagtatccgaaactgaggttgacacaaggaagaaaagtcttagagattcgaccaaccatcaaatgggataaaggcaaagctctcgagttcttgctcgaatccttaggattcgctaactctaacgatgttttgcccatctatataggagatgatcgtacggacgaggatgctttcaaggttttgagaaacaaaggacaaggctttggtatacttgtgtccaaaattccaaaggaaacgagtgctacatattctctacaagaaccttccgaggtaggagagtttttgcagcgactcgtggaatggaaacaaatgtcactaagaggaagatag

SEQ ID NO: 305 - protein, 369 aa, Arabidopsis thaliana
MTNHNALISDAKGSIGVAVRVPNQSLFSPGGGRYISIPRKKLVQKLEADPSQTRIHTWIEAMRASSPTRTRPGNISPLPESDEEDEYSSWMAQHPSALTMFEEIAEASKGKQIVMFLDYDGTLSPIVENPDRAYMSEEMREAVKGVARYFPTAIVTGRCRDKVRRFVKLPGLYYAGSHGMDIKGPSKRNKHNKNNKGVLFQAANEFLPMIDKVSKCLVEKMRDIEGANVENNKFCVSVHYRCVDQKDWGLVAEHVTSILSEYPKLRLTQGRKVLEIRPTIKWDKGKALEFLLESLGFANSNDVLPIYIGDDRTDEDAFKVLRNKGQGFGILVSKIPKETSATYSLQEPSEVGEFLQRLVEWKQMSLRGR

SEQ ID NO: 306 - DNA, 1065 bp, Arabidopsis thaliana
atggttagattcatcgaagaaaatattactaaaatgttggagacaaaggccatctcaaactcggaggttttatatgtcggaggagacgacggagacacgtcaccaacgacgaaagttcttcatgattttcagatcaacagcggaggaggactgataagatcatgggttgattctatgagagcttgttctcctactcgccctaaatccttcaatagccaatcttgttggattaaggaacatccatctgctttgaacatgttcgaagaaatacttcataaatctgaaggaaaacaaatagttatgtttcttgattatgatggtactctctctcccattgttgatgatcctgatcgagctttcatgtccaagaagatgcgaaatactgtgaggaaacttgcaaagtgttttccaacagccatagttagtgggagatgcagagagaaggtttctagttttgtgaaattaactgagttatactacgctggaagtcatggcatggacatcaaaggaccagagcaaggatctaaatacaagaaagaaaatcagtctcttctttgtcaacccgcaactgaattcctcccggtgataaacgaggtttataaaaaactagtcgagaacactcaatcgattccaggagcgaaagttgagaacaacaaattttgtgcgtctgttcactttcgatgcgtagaagaaaataaatggagtgacttggcccatcaagttcgatcagtcttgaagaattaccccaagctcatgcttacccaaggaagaaaagtattggagattcgtccaatcattaagtgggataaaggcaaagcactcgagtttttgttagaatcactaggatatgataattgtaccgatgtttttcctatatatattggagatgatcgtaccgacgaagacgcctttaagatactgagagacaaaaaacaaggtcttggaattcttgtgtccaaatacgcaaaggagactaatgcttcttattctttgcaagagccagatgaggttatggtttttttagaacgtttggtggaatggaaacagtcaaggtgtggggcatga

SEQ ID NO: 307 - protein, 354 aa, Arabidopsis thaliana
MVRFIEENITKMLETKAISNSEVLYVGGDDGDTSPTTKVLHDFQINSGGGLIRSWVDSMRACSPTRPKSFNSQSCWIKEHPSALNMFEEILHKSEGKQIVMFLDYDGTLSPIVDDPDRAFMSKKMRNTVRKLAKCFPTAIVSGRCREKVSSFVKLTELYYAGSHGMDIKGPEQGSKYKKENQSLLCQPATEFLPVINEVYKKLVENTQSIPGAKVENNKFCASVHFRCVEENKWSDLAHQVRSVLKNYPKLMLTQGRKVLEIRPIIKWDKGKALEFLLESLGYDNCTDVFPIYIGDDRTDEDAFKILRDKKQGLGILVSKYAKETNASYSLQEPDEVMVFLERLVEWKQSRCGA

SEQ ID NO: 308 - DNA, 1050 bp, Arabidopsis thaliana
atggttagattcatagaagaaaacacaaaacttgtagaaaaagaaaccgggaacaaatcaaacaacgatgtaacaacaacgaagaagaaagctcttcaagatatcattatcaacaatggagtaggattgatcaattcatgggttgattcaatgagagcttgttcccctactcatcttaaatctttgttgaaacaaagctcttggctcacggaacatccatcagctttggatatgtttgaagagattcttcacctttctgaaggaaaacaaatcgttatgttcttggattatgatggcactttatctcccattgttgatgatccagatcgagctttcatgtctagaaagatgagaagaactgtgaggaaactagcaaactgtttcccgacggccatagttagtgggagatgcatagaaaaggtttataactttgtaaaactaactgagttgtactatgctggaagtcatggaatggacatcaaaggaccagagcaagggtccaaatatgagcaaattttacaggatagtaaatctcttctttgccaaccagctacagagttcctccccatgatcgacgaggtttatcataaattagtggagaaaacaaaatctactcccggagcccaagtagagaacaacaaattttgtgtctctgttcacttccgacgcgtagatgaaaataactggagtgatttggctaaccaagttcgatcagtaatgaaagactaccctaagctccgtcttactcaaggaagaaaagttttggaggttcgtccgattattaaatgggacaaaggcaaagcactcgagtttttattagagtcacttggatacgctaattgtaccgacgttttccctctttatatcggagatgatcgcaccgacgaagatgcattcaaggtattgagagaacgaagacaaggtcttggcattcttgtatctaaatttccaaaggagactagcgcgtcttattcactgcaagaacccgatgaggttatggagttcttgcaacgtttagtggaatggaaacaattgagatctggagcatga

SEQ ID NO: 309 - protein, 349 aa, Arabidopsis thaliana
MVRFIEENTKLVEKETGNKSNNDVTTTKKKALQDIIINNGVGLINSWVDSMRACSPTHLKSLLKQSSWLTEHPSALDMFEEILHLSEGKQIVMFLDYDGTLSPIVDDPDRAFMSRKMRRTVRKLANCFPTAIVSGRCIEKVYNFVKLTELYYAGSHGMDIKGPEQGSKYEQILQDSKSLLCQPATEFLPMIDEVYHKLVEKTKSTPGAQVENNKFCVSVHFRRVDENNWSDLANQVRSVMKDYPKLRLTQGRKVLEVRPIIKWDKGKALEFLLESLGYANCTDVFPLYIGDDRTDEDAFKVLRERRQGLGILVSKFPKETSASYSLQEPDEVMEFLQRLVEWKQLRSGA

SEQ ID NO: 310 - DNA, 1110 bp, Arabidopsis thaliana
atgtcagctagtcaaaacattgtcgtatcagagactacaatgtcaagtatcatccccaacaacaacaacaacaacaacaactcttcttcacagaaactccctccttgtttaatctcaatttccaagaaaaagcttctcaagaacatcgacatcatcaatggtggtggacaaagaatcaacgcttgggtagattcaatgcgtgcttcttctcctactcatctcaaatctcttccttcttctatctccacacagcaacaactcaactcatggatcatgcaacatccttcagcactagaaaaattcgaacagataatggaagcttcgagagggaaacaaatcgtaatgtttcttgattatgacggtactctctctcccattgttgatgatccagacaaagctttcatgtcaagcaagatgagaagaacagtgaaaaaactggctaagtgtttccccactgctatagttactggtagatgcatagacaaggtgtataactttgtgaagcttgctgagctgtattatgctggaagccatggcatggacattaaaggtccagcaaaaggcttctccagacacaagagggttaaacagtctcttctgtaccaaccagctaatgactatcttcccatgatcgatgaagtttatagacaactcttggaaaaaacaaaatcgactccaggagccaaagtagaaaaccacaagttttgtgcttctgtgcactttcgctgcgtcgatgagaagaaatggagcgaactggttctacaggttcggtcggtattaaagaaattccctacgctgcaactgacccaaggtcggaaggttttcgaaatccgtccaatgattgaatgggataaaggaaaggctcttgagttcttgttagaatcacttggatttgggaacactaacaatgttttcccggtttatattggtgacgatcgaactgacgaagatgcatttaagatgctacgagacagaggcgaaggctttggcattcttgtctccaagtttcccaaggatactgatgcttcgtattctttgcaagatccatccgaggtgatggatttcttacgacgattggtggaatggaaacaaatgcagccaagaatgtga

SEQ ID NO: 311 - protein, 369 aa, Arabidopsis thaliana
MSASQNIVVSETTMSSIIPNNNNNNNNSSSQKLPPCLISISKKKLLKNIDIINGGGQRINAWVDSMRASSPTHLKSLPSSISTQQQLNSWIMQHPSALEKFEQIMEASRGKQIVMFLDYDGTLSPIVDDPDKAFMSSKMRRTVKKLAKCFPTAIVTGRCIDKVYNFVKLAELYYAGSHGMDIKGPAKGFSRHKRVKQSLLYQPANDYLPMIDEVYRQLLEKTKSTPGAKVENHKFCASVHFRCVDEKKWSELVLQVRSVLKKFPTLQLTQGRKVFEIRPMIEWDKGKALEFLLESLGFGNTNNVFPVYIGDDRTDEDAFKMLRDRGEGFGILVSKFPKDTDASYSLQDPSEVMDFLRRLVEWKQMQPRM

SEQ ID NO: 312 - DNA, 1113 bp, Arabidopsis thaliana
atggtgagccaaaacgtcgtcgtatcagacgccaagaccgggatcataacggtctctacagtctctaactcctctgtctttactcctaccgctcaaaaaccaccgactgctcctggttacatctcagtttccaagaaaaaactcctcaaaaaccttgaaatcaatggagctgatcaaagtcaaagacttaactcttgggttgactccatgagagcttcttctcctacccatctcaaatcactttcctctttctcttccgaagaagaacacaattcttggatcaaacgacatccatcagcacttaacatgttcgaacgaatcatcgaagaagcaagaggaaaacaaatcgtcatgtttcttgattatgacggtactctttctccgatcgtggatgatccagacagagctttcatgactagcaagatgagaagaacagtgaaaaaaatggctaagtgttttccaacttccatagttactggtagatgcatcgacaaggtttatagctttgtgaagctagcagaactgtattatgctggaagccatgggatggatattaaaggcccaactaaaggtttctcaagatacaataaggataaaccatccgttctttaccaaccagccggcgactttcttcccatgatcgatgaggtttataaacaattagtggagaaaaccaaatctacaccaggagccaaagtggagaacaacaagttctgtctttctgtgcacttccgttgtgttgacgagaagaaatggagcgagctggcttcaaaagttcggtcggtggtaaagaactatccgacgttgaaactgtctcaaggtcgaaaggtttttgaaatccgacctataattaaatggaacaaaggcaaggctcttgagtttttgttagagtcactcggatttgaaaactgtaacgatgtatttccaatttacattggtgatgataaaaccgatgaagatgcatttaagctactacgagggagaggacaaggctttggtattcttgtctccaagttccccaaagacaccagtgcgtcgtattctttacaagacccacctgaggtgatgaatttcttgggacggttggtggagtggaaacagatgcagcaataa

SEQ ID NO: 313 - protein, 370 aa, Arabidopsis thaliana
MVSQNVVVSDAKTGIITVSTVSNSSVFTPTAQKPPTAPGYISVSKKKLLKNLEINGADQSQRLNSWVDSMRASSPTHLKSLSSFSSEEEHNSWIKRHPSALNMFERIIEEARGKQIVMFLDYDGTLSPIVDDPDRAFMTSKMRRTVKKMAKCFPTSIVTGRCIDKVYSFVKLAELYYAGSHGMDIKGPTKGFSRYNKDKPSVLYQPAGDFLPMIDEVYKQLVEKTKSTPGAKVENNKFCLSVHFRCVDEKKWSELASKVRSVVKNYPTLKLSQGRKVFEIRPIIKWNKGKALEFLLESLGFENCNDVFPIYIGDDKTDEDAFKLLRGRGQGFGILVSKFPKDTSASYSLQDPPEVMNFLGRLVEWKQMQQ

SEQ ID NO: 314 - DNA, 1080 bp, Brassica napus
atggtgagattcatcgaagagaatattactaaaatgttggagacaaagatcatctctaagtcggaagttttatatgctggaggagacgacggagacacgtcgccggcgactaaaatttttcaagattttcagatcaacgaagaagacgtcggaagaggaggagggctaataagatcatgggttgattccatgagagcatgttctcctactcatctcaaacctttcgacaaccaatcttcttggatcaaagaacatccatcagctttgaacatgttcgaagaaatacttcatgaatcagaaggaaaacaaatcgtcatgtttcttgattacgatggtactctctcccccattgttgatgatcctgatcgcgctttcatgtctaacaagatgcgaaacactgtaaggaaacttgcaatgtgttttccaacagtcatagttagtgggcgatctagagagaaggtttatagttttgtgaaactaactgagttgtactatgctggaagtcacggaatggacatcaaaggaccagagcaaaattccaaatacaaaaaaaaaacccaatctcttctttgtcaacccgcgacggagttccttccggtgattagtgaggtgtatatgaaactagtcgagaaaacaaaatcgattcaaggagccaaagttgaaaacaacaaattttgtgcttctgttcactttcgatgcgtagacgaaaataaatggagtgacttggcccatctagttcgatcagttctgaagaactaccccaagctcatgcttacgcaaggaagaaaagtgttggagattcgtccaatcattaaatgggacaaaggcaaagcacttgagttcttgttagaatccctcggatatgagaattgtacccatgtcttccctatatatattggagatgatcgtaccgacgaagatgcctttaagattttgagagataaaagacaaggtcttgggatccttgtatccaaatacgcgaaggagaccaatgcttcttattctttgcaggagccagacgaggttatggattttttggaacgtctggtggaatggaaaaagttaaagagtggggaatga

SEQ ID NO: 315 - protein, 359 aa, Brassica napus
MVRFIEENITKMLETKIISKSEVLYAGGDDGDTSPATKIFQDFQINEEDVGRGGGLIRSWVDSMRACSPTHLKPFDNQSSWIKEHPSALNMFEEILHESEGKQIVMFLDYDGTLSPIVDDPDRAFMSNKMRNTVRKLAMCFPTVIVSGRSREKVYSFVKLTELYYAGSHGMDIKGPEQNSKYKKKTQSLLCQPATEFLPVISEVYMKLVEKTKSIQGAKVENNKFCASVHFRCVDENKWSDLAHLVRSVLKNYPKLMLTQGRKVLEIRPIIKWDKGKALEFLLESLGYENCTHVFPIYIGDDRTDEDAFKILRDKRQGLGILVSKYAKETNASYSLQEPDEVMDFLERLVEWKKLKSGE

SEQ ID NO: 316 - DNA, 1128 bp, Brassica napus
atggtgagttttgtcatggagaaaccacacaggatgtcagagagtcaaaacgttgtcgtctcagaggcggcaaggtctatcatccccaacaactcttcggctcctcctggtttcatctcaatctccaagaaaaagcttctcaagaacctagaaatcatcaatgatggcgaaagaatcaacgcttgggtagattcaatgcgagcttcttctcctactcatccaaaatcactcccttcttccatctcctcagagcaacaactcagttcatggatcatgcagcatccttctgcgttagaaatgtttgagaaaatcacagaagcttcgggagggaaacaaatagtaatatttctagattatgacggtactctctctcccatcgttgatgatccagacagagctttcatgtcaagcaagatgagaagaacagtaaaaaaactggctaagtgttttccaactgctatagttactggtagatgcctagacaaggtgtataactttgtcaagctagctgagctgtattatgctggcagccatggcatggacattaaagggccagcaaaaggcttctccagacacaagagggttaaacagtctcttctgtaccaaccagccagtgactatcttcccatgatcgatgaagtctatagacaacttttggagaaaaccaaatcaactcctggagtcatagtagaaaacaacaagttctgtgcttctgtgcactttcgttgcgtcgatgagaagaaatggagcgaactggttctacaggttcggtcggtattaaaggaataccctaggcttaaactgaaccaaggtcgaaaggttttcgaaatacgtcctatgattgaatgggataaaggaaaagctcttgagttcttgttagagtcacttgggtttggaaactctaacaacgttttcccagtttacatcggtgatgaccggaccgacgaagatgcatttaagctgctacgagacagaggtgaaggctgtggcgttcttgtctccaaattccccaaagatacggatgcttcatattatttgcaagatccgtccgaggtgatgaatttcttgcaacgattggtggcgtggaaacaaatgcagccaaagagtgtgaagaggatgtatgtataa

SEQ ID NO: 317 - protein, 375 aa, Brassica napus
MVSFVMEKPHRMSESQNVVVSEAARSIIPNNSSAPPGFISISKKKLLKNLEIINDGERINAWVDSMRASSPTHPKSLPSSISSEQQLSSWIMQHPSALEMFEKITEASGGKQIVIFLDYDGTLSPIVDDPDRAFMSSKMRRTVKKLAKCFPTAIVTGRCLDKVYNFVKLAELYYAGSHGMDIKGPAKGFSRHKRVKQSLLYQPASDYLPMIDEVYRQLLEKTKSTPGVIVENNKFCASVHFRCVDEKKWSELVLQVRSVLKEYPRLKLNQGRKVFEIRPMIEWDKGKALEFLLESLGFGNSNNVFPVYIGDDRTDEDAFKLLRDRGEGCGVLVSKFPKDTDASYYLQDPSEVMNFLQRLVAWKQMQPKSVKRMYV

SEQ ID NO: 318 - DNA, 1101 bp, Brassica napus
atggtgagccaaaacgtcgtcgtatcagacgccaatacaggaatcataaccgtctccaactcctccgtctttgctccttccgctcaaaaaccaccgactgttcctggtcacatctcaatttccaagaagaaactactcaagaacctagaactcagtggcgctcaaagtcaaagactcaactcttgggttgactccatgagagcttcttctcctactcatctcaaatcactttcttctctttcatcagaagaagagctcaattcttggcttaaacgacatccatcggctcttgacatgtttgaaagaatcatcgaaacttcaagaggaaaacagatcgttatgtttcttgactatgacggtactctttctccaatcgtcgctgatccagacagagcttttataaccagcaagatgagaagaacagtgaaaaaactggccaagtcctttccaacttctatagttactggtagatgcatagacaaggtgtatagctttgtgaagctagcagaactgtattatgctggtagccatggaatggatattaaaggtccaacaaaaggtttctccagatacaataaggataaaccatctgttctttatcaaccagctggagactttcttcccatgatcgatgaggtttttaaacaattagtggagaaaaccaaatcaacaccaggagccaaagtggagaacaacaagttctgtctttctgtacacttccgttgcgtcgatgagaagaaatggagcgacctggctttaaaagttcggtcggtggtaaagaactatccgacattgaaactgtcccaaggtcggaaggtttttgaaatccgacctatgattaaatgggacaaaggcaaggctcttgagtttttgttagagtcacttggatttgagaactctaacgatgtatttccgatatacattggtgacgatcgaaccgatgaagatgcttttaagctgcttcaagagagaggacaaggcttcggcattcttgtctccaaatttcccaaagacactaatgcatcgtattctttgcaagatccacccgaggtgatggatttcttgcgacggttggtggagtggaaacaaattcaacaatga

SEQ ID NO: 319 - protein, 366 aa, Brassica napus
MVSQNVVVSDANTGIITVSNSSVFAPSAQKPPTVPGHISISKKKLLKNLELSGAQSQRLNSWVDSMRASSPTHLKSLSSLSSEEELNSWLKRHPSALDMFERIIETSRGKQIVMFLDYDGTLSPIVADPDRAFITSKMRRTVKKLAKSFPTSIVTGRCIDKVYSFVKLAELYYAGSHGMDIKGPTKGFSRYNKDKPSVLYQPAGDFLPMIDEVFKQLVEKTKSTPGAKVENNKFCLSVHFRCVDEKKWSDLALKVRSVVKNYPTLKLSQGRKVFEIRPMIKWDKGKALEFLLESLGFENSNDVFPIYIGDDRTDEDAFKLLQERGQGFGILVSKFPKDTNASYSLQDPPEVMDFLRRLVEWKQIQQ

SEQ ID NO: 320 - DNA, 1146 bp, Glycine max
atgatgacgaaccaaaatgtggtgactcatgaggttattaacacgttgattgccgtggcagcttccatttcaaactcaaccgcgttgccaagtgcaacagtgccagaatccatggctgtgcttggtgggttttgggggctgccccataataaaaatcttgtgaaaaggttggaaggagctaaagttagtgcttggattgattcaatgagagcttcttccccaactcgtgccaaatcagaaagccaagaaaaaagatcttggattctttatcacccttcagctctgaacacgtttgagcaaatagtatgtagtgccaaaggaaagcaagtcgtagtttttcttgactacgatggaactctctccccaattgttgcagatccggataaagctttcatgactagaaagatgagagcaacgctaaagggcatagcaaggcattttcccacagcaatagtgaccggaaggtgcagagacaaggtatataactttgtaaaattggcagaactttactatgccggaagccatggcatggacatcaagggtccaacaaaaagccaaagtccaaagcaaggtaataataataaagcagtgctgttccaacccgcgagtcaattcctgccaatgatcgatgaggtgtacaagatcttgttagaaaaaacaaagactgtcccaggggctaatgttgagaacaataagttttgcttgtccgtgcactttcgttgtgttgacgaaaagagttgggcagcgttggcggagaaagttagattggtgctcaatgattacccacaacttaggctaacccaagggagaaaagtgctagagattcgtccaaccatcaaatgggacaagggcaaggctcttgaatttttgttagaatcattaggatacgagaattcgaatgatgtatttccaatatatattggtgatgatcgaactgatgaggatgcttttaaggttttgcgcagtaggggtcaaggaattgggattcttgtttctagagttgcaaaagaaacagatgcttcctataccttgcaagatccatcagaggcaagtgctatatattccatccagtacaatttattctatataatatttttaatgtttaattcgggcatcaatgttgtatatctttattgtgaatggtga

SEQ ID NO: 321 - protein, 381 aa, Glycine max
MMTNQNVVTHEVINTLIAVAASISNSTALPSATVPESMAVLGGFWGLPHNKNLVKRLEGAKVSAWIDSMRASSPTRAKSESQEKRSWILYHPSALNTFEQIVCSAKGKQVVVFLDYDGTLSPIVADPDKAFMTRKMRATLKGIARHFPTAIVTGRCRDKVYNFVKLAELYYAGSHGMDIKGPTKSQSPKQGNNNKAVLFQPASQFLPMIDEVYKILLEKTKTVPGANVENNKFCLSVHFRCVDEKSWAALAEKVRLVLNDYPQLRLTQGRKVLEIRPTIKWDKGKALEFLLESLGYENSNDVFPIYIGDDRTDEDAFKVLRSRGQGIGILVSRVAKETDASYTLQDPSEASAIYSIQYNLFYIIFLMFNSGINVVYLYCEW

SEQ ID NO: 322 - DNA, 1119 bp, Glycine max
atgacgaaccgtaatgtgaataacacccttgtggagttggcaatgtcgatttcaaacacaagtgctctacctagagctacggtgcctggaataatggccttgcttggtggggttttgggcctaccccagaagaagctcttaatgaaaactttggaagatggaagtgttaataaaggagggaccaaagttattaacacatggattgattcaatgagagcctcttctcccacacgagtcaaatccacacaaaaccaagacccaacaagtccttggacactttaccacccttcggcactgagcatgtttgatcagattgtatgtgagtccaaaggaaagcagattgtgacttttcttgactatgatggaactctctccccaattgttgcagatccagataaagcatacatgagtaaaaagatgaggaccacattgaaggacttagcaaggcatttccccactgccatcgtgagtggaaggtgcctagacaaggtgtataactttgtaagattggcagaactgtactatgctgggagccatggaatggacatcaagggaccaacaaataagcgaagtactaagaaggaaaatgaacaagtgctcttccaacccgctagtgaattcttgcccatgatcaatgaggtgtacaacatcttggtggaaaaaacaaagtctgtccctggggctaaggtagaaaataacaagttttgcttgtccgtgcactttcgctgtgttgacgaaaagagttgggtgtcattggctgaacaagtgagcttcgtgctcaacgagtacccaaaacttaagctaactcaagggagaaaagtgcttgagattcgaccaaccataaaatgggacaagggcaaggctcttgaattcttgctagagtcactgggatatgctaattctgataatgtatttccaatctatattggggatgatcgaactgatgaagatgcttttaaggttttacggaggaggggtcatggggttgggattctagtttctaaaattccaaaagaaactgatgcttcctacactttgcaagatccaacagaggttgggcagtttttgaggcatttggtggagtggaaaagaacgagttcccaataccacaagttgtag

SEQ ID NO: 323 - protein, 372 aa, Glycine max
MTNRNVNNTLVELAMSISNTSALPRATVPGIMALLGGVLGLPQKKLLMKTLEDGSVNKGGTKVINTWIDSMRASSPTRVKSTQNQDPTSPWTLYHPSALSMFDQIVCESKGKQIVTFLDYDGTLSPIVADPDKAYMSKKMRTTLKDLARHFPTAIVSGRCLDKVYNFVRLAELYYAGSHGMDIKGPTNKRSTKKENEQVLFQPASEFLPMINEVYNILVEKTKSVPGAKVENNKFCLSVHFRCVDEKSWVSLAEQVSFVLNEYPKLKLTQGRKVLEIRPTIKWDKGKALEFLLESLGYANSDNVFPIYIGDDRTDEDAFKVLRRRGHGVGILVSKIPKETDASYTLQDPTEVGQFLRHLVEWKRTSSQYHKL

SEQ ID NO: 324 - DNA, 1089 bp, Glycine max
atgacgcagaatgcgatagtgtccaagacaaaatcggggatcaaccgggacataaccgtgccacaaaagccactggcggcggcggcggcggcgggggggtacattcccattccgaggaggagggttttgaagaacctggaaatcaatgcatgggttgattccatgagatcctcttctccaaccaattccaaatccacctcttctctcgcagaagaacacagcacttggattcttcgccacccctcagcattagacatgttcgagcaaattatggatgcgtcccggggaaagcaaattgtcatgtttctcgactatgatggtactttgtcgcctattgttgatgacccagaccgtgctttcatgtcggattcgatgaggagaacggtgaggaaacttgcaaggtgttttcctactgctatagttaccggcagatgcaaagacaaggtttacaattttgttcgcttggctgagctatattatgctggaagccatggcatggatattcaagggccaacaagaacctccaaatacagcaacaaagataaaggagagcctgttctttttcaacctgctagtgaatttcttcccatgattgatgaggtgtaccatcaattagttgagaaaatgaaatcaattcctggagccatggtggagaacaacaagttctgctgttctgttcattttcgctgcgttgatgaaaagaaatggagtgaactggcacaggaagtgagatcagtattaaaagagtacccgaagcttcgtcttaaccaaggaaggaaggtattagagattcgtccatctattaaatgggacaaagggaaggcgctggaatttttgttagagtcacttggatttgccaactgtaacgatgtctttcctgtttacattggagatgataaaaccgatgaagatgcattcaagaaattaagagacagaggacaaggttttgggattcttgtctcgaaatttccaaaggacactactgcatcatactctttacaagaaccaaacgaggtgatggatttccttcaacgtttggtggagtggaaacaagtatccctccgactcagaacacgttctcgggtgtaa

SEQ ID NO: 325 - protein, 362 aa, Glycine max
MTQNAIVSKTKSGINRDITVPQKPLAAAAAAGGYIPIPRRRVLKNLEINAWVDSMRSSSPTNSKSTSSLAEEHSTWILRHPSALDMFEQIMDASRGKQIVMFLDYDGTLSPIVDDPDRAFMSDSMRRTVRKLARCFPTAIVTGRCKDKVYNFVRLAELYYAGSHGMDIQGPTRTSKYSNKDKGEPVLFQPASEFLPMIDEVYHQLVEKMKSIPGAMVENNKFCCSVHFRCVDEKKWSELAQEVRSVLKEYPKLRLNQGRKVLEIRPSIKWDKGKALEFLLESLGFANCNDVFPVYIGDDKTDEDAFKKLRDRGQGFGILVSKFPKDTTASYSLQEPNEVMDFLQRLVEWKQVSLRLRTRSRV

SEQ ID NO: 326 - DNA, 1179 bp, Hordeum vulgare
atggcgcagacgagcgtggtcgtgtcagaggtgggcatcacggcgaccgcggccacggccacggcgtgcccctgcccggggtcgctgttcccgtacccgccgccgcgtgccgggatggccgtgagccggaagtgcctgcgggcggcgcaggcggagcttggcgcggggatgctcagtggcctggtcgagtccatgcgggcgtcgtcccccacgcacgccagggccgctgccgccctcgctgccggcgtcgacgacgagcacgcggcctggatggccaggcacccctccgccctggccaagttcgaggagatcgtggccgcctccaaagggaagcagatcgtcatgttcctcgactacgaccgcacactggcccccatcgtcaatgaccccgaccccgccttcatgagcgagacgatgcggatggccgtgcgcagcgtggccaagcacttcccgacggcgatcgtcagtggtcggtgccgcgacaaggtgtttgagttcgtgaagctggcggagctctactacgccggcagccacggcatggacatcaagggcccggccaaatcctcttccgggcacgcaaagtccaaggccaaaggagttctcttccaaccagcaagcgagttcctgcccatgatagaagaggtgcatcaacgcctgatagaggagaccaagcacgtagccggcgccaaggtggagaacaacaagttctgcgtctccgtccacttcagatgcgtcgacgaaaagagctggggcgcgctggcggagacggtgaagggggtgatgcgggagtacccgaagctgcgcatgtcgcaggggcggatggtgttcgaggtgcggcccaccatcaagtgggacaagggcaaggccctcgagttcctgctcgagtcgctgggcttcgccgactgcagcaacgtgctgcccgtctacatcggcgacgaccgcaccgacgaggacgccttcaaggtgctgcggcggaggggccagggcgtcgggatcctcgtctccaagcaccccaaggacaccagcgcgatccttctcgctgcaggagcccgccgaggtcatggagttcctcctccgcctcgtcgagtggaagcagctctccagggcgcgcctcaggctgcggcgacaggcccacgcctgatcggacgaccacgaggatcggccggccgggctaattaa

SEQ ID NO: 327 - protein, 392 aa, Hordeum vulgare
MAQTSVVVSEVGITATAATATACPCPGSLFPYPPPRAGMAVSRKCLRAAQAELGAGMLSGLVESMRASSPTHARAAAALAAGVDDEHAAWMARHPSALAKFEEIVAASKGKQIVMFLDYDRTLAPIVNDPDPAFMSETMRMAVRSVAKHFPTAIVSGRCRDKVFEFVKLAELYYAGSHGMDIKGPAKSSSGHAKSKAKGVLFQPASEFLPMIEEVHQRLIEETKHVAGAKVENNKFCVSVHFRCVDEKSWGALAETVKGVMREYPKLRMSQGRMVFEVRPTIKWDKGKALEFLLESLGFADCSNVLPVYIGDDRTDEDAFKVLRRRGQGVGILVSKHPKDTSAILLAAGARRGHGVPPPPRRVEAALQGAPQAAATGPRLIGRPRGSAGRAN

SEQ ID NO: 328 - DNA, 1104 bp, Oryza sativa
atgacgaaccaggacgtggtggtttctgagatgggcatcgcggcaggcgcggcgctgccgggaggaccggccggcccggcgggcggcctcttcgcgtgccgcagcgcggccgcgtcgatgaggcagacgtacctcgacctcgccgcggcggcggtggcggcgcgctccgcgagctgcaccagctgggccgacgccatgcgcgcctcctcccccacccgctcgtcccgctccgcctccgacgtcgacgagttcaccgcctgggtgaggaagcacccgtcggcgcttagcaagttcgaggagatcgccgccaagtccagggggaagaagatcgtaatgttcatggactacgacggcacgctctctcccatcgtcgccgaccccgacacggcctacatgagcgacgcgatgagggcggcggtgcgcgaagtcgccaagaccttcccgacggcgatcgtcagcgggcggtgccgcgacaaggttcgcaacttcgtcggcctctccgacctctactacgccggcagccatggcatggacatcaagggaccaagctccaacccggagtctgccctttgccagccagcaagcgagttcctccccatgatcgacgaggtgtacaagacgctggtggaaaagacgaaatctacacctggagccaaggtggagaacaacaagttctgcctgtccgtccacttcagatgtgtagatgaaaagagatggaatgctttgggggagcaggtcaaggccgtgatcaaggaatacccaaagttgaagcttacccaaggaaggaaggttttggagatcaggccgagcattgagtgggacaagggcaaggctctggagttcttgcttgaatcgctgggattcgccaactgcggcgacgtcatgccggtgtacatcggtgacgaccgcaccgacgaggacgccttcaaggtgttgagaaagagaggtcagggcctgggaatcctagtctccaagtgccccaaggacaccaacgcctcctactctctccaggacccaacagaggtgatggagttcttgctcaggctggtggagtggaagcggaagtcgtcgtcgtcgtcgttgatgattcgtccgagagtgtag

SEQ ID NO: 329 - protein, 367 aa, Oryza sativa
MTNQDVVVSEMGIAAGAALPGGPAGPAGGLFACRSAAASMRQTYLDLAAAAVAARSASCTSWADAMRASSPTRSSRSASDVDEFTAWVRKHPSALSKFEEIAAKSRGKKIVMFMDYDGTLSPIVADPDTAYMSDAMRAAVREVAKTFPTAIVSGRCRDKVRNFVGLSDLYYAGSHGMDIKGPSSNPESALCQPASEFLPMIDEVYKTLVEKTKSTPGAKVENNKFCLSVHFRCVDEKRWNALGEQVKAVIKEYPKLKLTQGRKVLEIRPSIEWDKGKALEFLLESLGFANCGDVMPVYIGDDRTDEDAFKVLRKRGQGLGILVSKCPKDTNASYSLQDPTEVMEFLLRLVEWKRKSSSSSLMIRPRV

SEQ ID NO: 330 - DNA, 1125 bp, Oryza sativa
atgacgaagcacggcgcggtggttgtcccggaggatgccgtggtggcggcggcggccgtcgggcggcatttctcgttcccgccgccgaggacggggggcgtcggcggcgactcgtgcaagaagctggcggcgcagcagatcgacctcggcgccgcggtgatcgggtcgtggctcgactccatgaaggcgtcctcgccgcggcacaggctcgtggcgcccgcggtcgccgccgccgccgccgacgcggagcacgacgagtggatggagaagcacccgtcggcattggggaagttcgaggcgctggcggcggcggcgaaggggaagcggatcgtcgtcttcctcgactacgacggcacgctgtcgccgatcgtcgaggaccccgaccgcgccgtcatgacggacgagatgagggacgccgtgcgcggcgtggcggcgcgattcccaacggcgatcgtcagcggccgctgcagagacaaggtgttgagcttcgtggggctggaggagctctactacgcgggtagccacgggatggacatccaagggcccaccaacgccgccgcctccaagggaggagaggaggaggaggagtcggtgctgtgccagccggcgagggagttcctgccgatgatcggggaggcgtacgcggcgctggtggagaaggtggagggggtgatcccgggggcgaaggtggagaacaacaagttctgcctctccgtccacttccgccgcgtcgacgagcgccggtggggcgccgtcgccgaccaggtcagggcggtgctccggggctacccgcgcctccgcctcacgcagggccgcaaggtgctcgaggtcaggcccgccatcaagtgggacaagggcgaggccctccgcttcctcctctccgccctcggcttctccgccgccggagacgtagaagacgacggcgacgacgacgacgcgttccccatctacatcggcgacgaccgcaccgacgaggacgcgttccgggtgctccgagcgagggggcacggcgccggcatcctggtgtcgaggttccccaaggacacctgcgcctccttctccctccgcgaccccggcgaggtcaaggacttcctccgcaagctcgtcacctgcgctgccgcatga

SEQ ID NO: 331 - protein, 374 aa, Oryza sativa
MTKHGAVVVPEDAVVAAAAVGRHFSFPPPRTGGVGGDSCKKLAAQQIDLGAAVIGSWLDSMKASSPRHRLVAPAVAAAAADAEHDEWMEKHPSALGKFEALAAAAKGKRIVVFLDYDGTLSPIVEDPDRAVMTDEMRDAVRGVAARFPTAIVSGRCRDKVLSFVGLEELYYAGSHGMDIQGPTNAAASKGGEEEEESVLCQPAREFLPMIGEAYAALVEKVEGVIPGAKVENNKFCLSVHFRRVDERRWGAVADQVRAVLRGYPRLRLTQGRKVLEVRPAIKWDKGEALRFLLSALGFSAAGDVEDDGDDDDAFPIYIGDDRTDEDAFRVLRARGHGAGILVSRFPKDTCASFSLRDPGEVKDFLRKLVTCAAA

SEQ ID NO: 332 - DNA, 1101 bp, Oryza sativa
atgacgaaccacgccggcttcgccgcggacgacgcggtcaccgcggccgtgccggtgcaggcggcgcagggcgggcggcatttcccgccgttcctggcgccgtcgtccaggctcaccgactgcaagaaggcggcggcgcacgtggacctcgccggcgcgggcggggtggcgacggtgcccggatcttggccgcgccacgccaagcccgtctccggcgccgagctcgacgactggatggagaagcacccgtcggcattggcatggttcgagtccgtcgccgccgcggcgaagggcaaggagatcgtcgtgttcctcgactacgacggcaccctctcccccatcgtcgccgaccccgaccgcgccttcatgtccgacgaaatgagagaggcggtgagaggcgtggcgaagcacttcccgacggcgatcgtgagcgggaggtgcatcgacaaggtgttcgactttgtgaagctggaggagctgtactacgccgggagccatggaatggacatcaggggccccaccgcggcagcgtcggagtacaaccacaacatgaaggcaaagcagggtgatgctgttactttccagccggccgccgatttcctgcccgtcatcgaggaggtgtatcatgtgctgaaggagaggatggcgagtataaggggttcgctggtggagaacaacaagttttgcctttccgtgcactaccgctgcgtcgacgaggcggaatggggcgtgctggacggcaaggtgagggcggtgatagagggctacccggatctccgtctcagcaaggggagaaaggtgctggagatccgccctgtcatcgactgggacaaaggctccgcactccagttcctgctcaaatctctcggttatgaggggcgcaacaatgttttcccgatatacattggagatgaccgcaccgacgaggatgctttcaaggtgttgcgcaacatgggacagggcataggaatccttgtgaccaaggtcccaaaggagacagctgcatcctacactctgcgagagccatccgaggtgaaggagttcctgcgcaagttggtgaagattaagatcaacggggacaaagggctgattggcaagtag

SEQ ID NO: 333 - protein, 366 aa, Oryza sativa
MTNHAGFAADDAVTAAVPVQAAQGGRHFPPFLAPSSRLTDCKKAAAHVDLAGAGGVATVPGSWPRHAKPVSGAELDDWMEKHPSALAWFESVAAAAKGKEIVVFLDYDGTLSPIVADPDRAFMSDEMREAVRGVAKHFPTAIVSGRCIDKVFDFVKLEELYYAGSHGMDIRGPTAAASEYNHNMKAKQGDAVTFQPAADFLPVIEEVYHVLKERMASIRGSLVENNKFCLSVHYRCVDEAEWGVLDGKVRAVIEGYPDLRLSKGRKVLEIRPVIDWDKGSALQFLLKSLGYEGRNNVFPIYIGDDRTDEDAFKVLRNMGQGIGILVTKVPKETAASYTLREPSEVKEFLRKLVKIKINGDKGLIGK

SEQ ID NO: 334 - DNA, 1113 bp, Oryza sativa
atgacgaagcagagcgtggtggtgccggaggtggcggtgccgatgccgcccaactccgcgccgctgctcccgtacccgccgccgcgggccgcgccgggcgtcgccgtgcgcaagaagtacctccaggcgcagctcgacctcggcgcgggcctcccgctcatcaacggatgggtggagtccatgcgggcctcctcccccacccacgccaaggccgccgccgcgctcgccgccgccggcgccgtcgacgacgagcgcgccgcctggatggtgaggcacccgtcggcgctgagcaagttcgagcagatcgtggcggcgtccaaggggaagaagatcgtcatgttcctcgactacgacggcacgctgtcccccatcgtcgacgacccggactccgccttcatgtccgacacgatgcggcgggcggtgcgcagcgtcgccaagcacttcccgacggcgatcgtcagcggccggtgccgcgacaaggtgttcgagttcgtgaagctggcggaactctactacgccggtagccatggcatggacatcaagggccccgcgaaggcctcccgccacaacaaggccaaggcgaaaggcgttctctttcagccggctagcgagttcctccccatgatagaacaggtgcacgattctctgatagaaaggaccaagtgcatacctggagccaaggtggagaacaacaagttctgtgtgtctgtccacttcagatgtgtcgatgaaaagagctggagcacattggctgacatagtgaaggcagagctcaaggactaccccaaactgaagctcacgcaggggaggatggtgttcgagatccggcccaccatcaagtgggacaagggcaaggccctcgagttcctcctcgagtcgctagggttcgccgactgcaccaacgtgctgccggtgtacatcggcgacgaccggaccgacgaggacgcgttcaaggtgctccgcaagagaggccagggcatcggcatcctcgtgtccaagtaccccaaggacaccaacgcctcctactccctgcaggagccagccgaggtgatggagttcttgctgcggctggtggagtgggagcgcctctcccgtgctcgccccaagtggtga

SEQ ID NO: 335 - protein, 370 aa, Oryza sativa
MTKQSVVVPEVAVPMPPNSAPLLPYPPPRAAPGVAVRKKYLQAQLDLGAGLPLINGWVESMRASSPTHAKAAAALAAAGAVDDERAAWMVRHPSALSKFEQIVAASKGKKIVMFLDYDGTLSPIVDDPDSAFMSDTMRRAVRSVAKHFPTAIVSGRCRDKVFEFVKLAELYYAGSHGMDIKGPAKASRHNKAKAKGVLFQPASEFLPMIEQVHDSLIERTKCIPGAKVENNKFCVSVHFRCVDEKSWSTLADIVKAELKDYPKLKLTQGRMVFEIRPTIKWDKGKALEFLLESLGFADCTNVLPVYIGDDRTDEDAFKVLRKRGQGIGILVSKYPKDTNASYSLQEPAEVMEFLLRLVEWERLSRARPKW

SEQ ID NO: 336 - DNA, 1128 bp, Oryza sativa
atggcgaaggcgagcgtggtggtgcctgagcaggtgggcgcggcggcggcggcgcaggtggggtgcccctgtccgggcacgacgctgttcccgtacccgccgccgcgcgccgggatcgccgtgcggcgcaagtgcctgcaggcggcgcagcagctggagctcggcgccgggctgcgcggcggctgggtggagtccatgcgggcgtcgtcgcccacccacgccaaggccgccgccgccctcgccgccggcgtcgacgaggagcacgccgcctggatggcgaggcacccgtcggcgctgggcgagttcgagaaggtggtggcggcgtcgaaggggaagcagatcgtcatgttcctcgactacgacggcaccctctcccccatcgtcgacgaccccgacgccgccttcatgagcgagacgatgcggatggccgtgcgcagcgtggcgaagcacttcccgacggcgatcgtgagcgggcggtgccgcgacaaggtgttcgagttcgtgaagctcgccgagctgtactacgcggggagccacggcatggacatcaagggccccgcctcccgccacgccgccgccaagtctcctccccacaacaagggagtcctcttccagccggccagcgagttcctccccatgatcgagcaggtgcaccagcgactcgagcaggccaccagctccatcccgggcgccaaggtcgagaacaacaagttctgcgtctccgtccacttccggtgcgtcgacgagaagagttggggggcgttggcggagacggtgaggagggtggtgagggagttcccgcggctgcggctgagccaggggaggatggtgttcgaggtgcggccgaccatcaagtgggacaagggcaaggccctcgagttcctcctcgactcgctcggtttcgccgactgcagcgacgtgctgccggtctacatcggcgacgaccgcacggacgaggacgcgttcaaggttttgcggcggcgtgggcagggcgtggggatcctggtgtccaagcaccccaaggagacgagcgcctccttctccctccaggagcccgccgaggtgatggagttcttgctgcggctcgtggagtggaatcgcctgtccaggacacggttgaggctgtaa

SEQ ID NO: 337 - protein, 375 aa, Oryza sativa
MAKASVVVPEQVGAAAAAQVGCPCPGTTLFPYPPPRAGIAVRRKCLQAAQQLELGAGLRGGWVESMRASSPTHAKAAAALAAGVDEEHAAWMARHPSALGEFEKVVAASKGKQIVMFLDYDGTLSPIVDDPDAAFMSETMRMAVRSVAKHFPTAIVSGRCRDKVFEFVKLAELYYAGSHGMDIKGPASRHAAAKSPPHNKGVLFQPASEFLPMIEQVHQRLEQATSSIPGAKVENNKFCVSVHFRCVDEKSWGALAETVRRVVREFPRLRLSQGRMVFEVRPTIKWDKGKALEFLLDSLGFADCSDVLPVYIGDDRTDEDAFKVLRRRGQGVGILVSKHPKETSASFSLQEPAEVMEFLLRLVEWNRLSRTRLRL

SEQ ID NO: 338 - DNA, 1014 bp, Physcomitrella patens
atgattacatggattgatgcaatgaggtcgcagtcaccaccacaatttcgctctctacatggagaggctcctgaaactttcgacatcgagacagcagcatacagcgcgtggctcgagaagcacccgtcagctttgagttcgtttgacaaagtggtgaagcttgcgaaatccaagcaaatagttgtatttctcgactacgacggtactctgtcacctattgtcgataatccagaccgggctttaatgtctgatgagatgcgggctacagtaaaggagttggccacttgtttccctactgcaatcatcagtggaagagcgcgtccaaaggtttacgattttgtgcaattgtcggagttgtactatgctggaagtcatggaatggatataatgggtcctgcaaaaagttcaagtggttttaaagtcaacggaactcgagttaaagacaagaagggtaatgatgttgtatttttccaacctgcaagcgaatatcttccaatgatggacaaggtttgcagtgtcttgaatgatacgataagaaccataaaggatgcgcgggtcgaacacaacaagtattgtttgacggttcattttcgtcttgtgaaagaagagctttgggaaactcttgcaacaaaagttcaaaatgttttgaaggattacccaatgttgagtctcacgcatggccggaaggtcttggaggtccgcccatccattgcatgggacaaaggcaaagctgtaaactatcttctaaattctttgggttttgctgattcaagtgacgtcctacctgtatatattggagatgatcgtacagacgaggatgctttcaagttattgaatggtatgaagcatggttgcagcatattggtgtcatccattcccaagtcaactaaggccgccctttcgcttcgggaaccttcagaggtaatggaatttctgcgacgccttgtgcagtggaaaaaacgtggatcagagaaacggaatggcgtccaaaatggtcgttacttcatcaactaa

SEQ ID NO: 339 - protein, 337 aa, Physcomitrella patens
MITWIDAMRSQSPPQFRSLHGEAPETFDIETAAYSAWLEKHPSALSSFDKVVKLAKSKQIVVFLDYDGTLSPIVDNPDRALMSDEMRATVKELATCFPTAIISGRARPKVYDFVQLSELYYAGSHGMDIMGPAKSSSGFKVNGTRVKDKKGNDVVFFQPASEYLPMMDKVCSVLNDTIRTIKDARVEHNKYCLTVHFRLVKEELWETLATKVQNVLKDYPMLSLTHGRKVLEVRPSIAWDKGKAVNYLLNSLGFADSSDVLPVYIGDDRTDEDAFKLLNGMKHGCSILVSSIPKSTKAALSLREPSEVMEFLRRLVQWKKRGSEKRNGVQNGRYFIN

SEQ ID NO: 340 - DNA, 975 bp, Populus tremuloides
atgttcgcaaagaagactgaaactggaggcaaaaccaattcctgggctgattctatgagagattcttcacctacccgtgtcaaatccactacgtctttatcagaaatcgaggagaaaaatacttggattgtaaatcatccttctgctttgaacatgttcgagcaaatagtgaatggctcaaagggaaaacagattgtaatgtttttagattatgatggtacactgtcacccattgttgaagatcctgacagggcattcatgaccaacgagatgagagaagctgttagggacgtcgctagatactttcccactgctatagtgacgggaaggtgtagggataaggtgtacagcttcgtaagattggcagggctttattacgctggtagccatggcatggacatcaagggaccatccaagaattgttgcagaaacaaaaaagattatcaaggtgtactttttcaacctgccagtgattttttacccatgattgatgaggtgtacaatgctttgctggagagaacaaagtatatcccaggggctagagtagaagacaacaaattttgcatatccgtacactttcgttgtgtcgaggaaaagatgtgggctgcattagtagagcaagtaagatcagttctcaatggttatccaaaacttcgattaactcaagggaggaaggttttagagatccgacccaccattaaatgggacaagggcaaagctcttgagttcgtgttggaatcattaggatatgccaattctactgatgttttaccagtttatattggagatgatcgaactgatgaggatgcattcaaggttctaagaaacaggggacaagggcttgggattcttgtttctaaagttcccaaggaaacaaatgcctcgtattctctacaagagccaacagaggcaaactttttacggcgtttggttgagtggaagcgatcaacgttacaaggacaaagcagagtgtaa

SEQ ID NO: 341 - protein, 324 aa, Populus tremuloides
MFAKKTETGGKTNSWADSMRDSSPTRVKSTTSLSEIEEKNTWIVNHPSALNMFEQIVNGSKGKQIVMFLDYDGTLSPIVEDPDRAFMTNEMREAVRDVARYFPTAIVTGRCRDKVYSFVRLAGLYYAGSHGMDIKGPSKNCCRNKKDYQGVLFQPASDFLPMIDEVYNALLERTKYIPGARVEDNKFCISVHFRCVEEKMWAALVEQVRSVLNGYPKLRLTQGRKVLEIRPTIKWDKGKALEFVLESLGYANSTDVLPVYIGDDRTDEDAFKVLRNRGQGLGILVSKVPKETNASYSLQEPTEANFLRRLVEWKRSTLQGQSRV

SEQ ID NO: 342 - DNA, 1122 bp, Populus trichocarpa
atgacaaaccaaaatgtggtagtggctgatacaaactctggaatcaacttggcaatcacagtgcatgtaacaaattcctctatcttcaccacggccgcgcagaagcctccggcggctcctggtggttacatctctatttccagaaagaaacttttaaagaatcttgaaatcagtggaggagcaagatttaatgcttgggttaattccatgagaacctcttctcctactcatgtcaagtccacaccttctgctaatgacgaccaaagctcatggattcttcaccacccatcagcactggagatgtttgagcagataattgatgcctccaaaggaaagcaaatagttatgttcttggactatgatggcacactttctcctatcgttgatgacccagatagagctttcatgtccaagaagatgagagcaacagtgagaaagcttgcgagattttttcctactgcaatagtgagtgggagatgcagagacaaggtgtataactttgtacggttagcagaactgtactatgctggaagccatggcatggacatcaaaggaccagccaaaggcagcaaatacaagaaaggcagtgaaggtgttgtttttcaagctggcagtgagtttcttccaatgatagatgaggtttacaaagaactggtagagaaaactaaaacaactccaggggccaaggtggaaaataacaaattctgtctctctgtgcactatcgctgcgttgatgagaagaaatggagtggactggctcaagtagttaagtcagtgttgaaggagtacccaaagcttcgacttactcaaggaagaaaggttttagaaatccgccctaccattaaatgggacaaaggaaaggctcttgaatttttgttagagtctcttggattcgccaattgtactgatgtttttcctgtttacattggagatgatagaacagacgaggatgcatttaaggtgctgagagagagaggacaaggttttggtatcttggtctctaaattccccaaggacactagtgcatcttattccctacaagaacccacccaggtcatggattttttgcaacgtttggtgcagtggaaacggctagcctttcaagggcagtcaagggtttaa

SEQ ID NO: 343 - protein, 373 aa, Populus trichocarpa
MTNQNVVVADTNSGINLAITVHVTNSSIFTTAAQKPPAAPGGYISISRKKLLKNLEISGGARFNAWVNSMRTSSPTHVKSTPSANDDQSSWILHHPSALEMFEQIIDASKGKQIVMFLDYDGTLSPIVDDPDRAFMSKKMRATVRKLARFFPTAIVSGRCRDKVYNFVRLAELYYAGSHGMDIKGPAKGSKYKKGSEGVVFQAGSEFLPMIDEVYKELVEKTKTTPGAKVENNKFCLSVHYRCVDEKKWSGLAQVVKSVLKEYPKLRLTQGRKVLEIRPTIKWDKGKALEFLLESLGFANCTDVFPVYIGDDRTDEDAFKVLRERGQGFGILVSKFPKDTSASYSLQEPTQVMDFLQRLVQWKRLAFQGQSRV

SEQ ID NO: 344 - DNA, 867 bp, Triticum aestivum
atgtcccccgccggcgccgaccacgaggagtggatcgagaagcacccgtcagcattggagtggttcgagggcgtgctcgcggcggctgaggggaagcagatcgtcatgttcctcgactacgacggcaccctttcgccgatcgtcgaggaccccgaccgcgccgtcatgaccgaggagatgagggaggcggtgaggggcgtcgcccagcatttcccgaccgccatcgtgagtgggagatgcagagacaaggtgttcaactttgtgaaactggaggagctgtactacgccgggagccacggcatggacatcaagggccccaccaaagtgtccaaccacaaggcaaaggctgacgaggttctgtgccagccggcgaccgagttcttgcctgtcattcaggaggtgtatgagacgctgacggcgaagatggagtccatcccgggggccatggtggagaacaacaagttctgcctctcggtgcacttccgctgcgtcgaggaggcggagtgggacgttctgggcagggaggtgagggcggtgctgcacgactacccgaaactctgcctcaccaaggggagaaaggttctcgagatccggccctccatcgagtgggacaagggatacgccctcaagttcttgctcaagtctctcggctatgcggggcgcggcgacgttttcccgatatacatcggggatgaccgcacggacgaggatgcattcaaggtgctgcgcaacatgggacaaggcatcgggatcctcgtgaccaagtttccaaaggacacaagcgcgtcctactctctgcgtgagcctgctgaggtaaaggagttcctgcgcaagctggtgaagagcaacgggacaaagaaggggtaa

SEQ ID NO: 345 - protein, 288 aa, Triticum aestivum
MSPAGADHEEWIEKHPSALEWFEGVLAAAEGKQIVMFLDYDGTLSPIVEDPDRAVMTEEMREAVRGVAQHFPTAIVSGRCRDKVFNFVKLEELYYAGSHGMDIKGPTKVSNHKAKADEVLCQPATEFLPVIQEVYETLTAKMESIPGAMVENNKFCLSVHFRCVEEAEWDVLGREVRAVLHDYPKLCLTKGRKVLEIRPSIEWDKGYALKFLLKSLGYAGRGDVFPIYIGDDRTDEDAFKVLRNMGQGIGILVTKFPKDTSASYSLREPAEVKEFLRKLVKSNGTKKG

SEQ ID NO: 346 - DNA, 1101 bp, Zea mays
gacagatcgatatatcggatccccagcagttacacttacacagggacccccctccctgccttcttccaagacaaggccgatcgatcgatcgagcagctagctattctccatcgcacacgcactgcactgcacggccatgcatgtagaccaatgcatgcatgcgcgcagcagctaggttgttgttgttgttgctaggtagagatcgactactatctatgcataggtaggagcaaaaagaaaacaacaaaaaaaggccagttgtagctaataagcgcctctttgctgttgtgctcgtccatccatcgtccacgccatgcctagcttagctacatgcatgcatgcacgaggtcgtcttcattattcatggttggcgcgcccccttgttattggccagcttgcggaggaactccttgacctcggcagggtcactgagcgagtaggatgccgccgtctccttaggaagcttggacaccaggattccgatgccctgccccatgttgcggagcaccttgaaagcgtcctcgtcagtgcgatcatctccgatgtaaatcgggaagacgtcgttgcgcccagcatagccaagagacttgagcaagaactcgagggccttgcccttgtcccacttgatggacggacgaatctccagcacctttctgccgtgagtgagcttgaggttcgggtactccctgagcaccgacctgacctcctcgttcacggcattccattcctcctcccggacgcagcggaagtggacggacaggcagtacttgttgtgctccaccctggcgccggcgatggactccatcttggccgtcagcgtgcggaacacctcttcgatgaccggcaggaactcactcgcagcttggtaatggacagctgcggcttcagcctgcgtgtgtacgacctgctggacgtggttgggctgcctgcaggcggcggggccctggatgtccatgccatggctcccggcgtagtacagctccgtcagcttcacgaagttgagcaccttgtccctgcatcttccgctcacaatcgcggtggggaagtgctcggcgacgcgccgcacggcttctctcatctcctccgacatgacggcgcggt

SEQ ID NO: 347 - protein, 366 aa, Zea mays
MTKHAAYSSEDVVAAVAAPAPAGRHFTSFQALKGAPLDCKKHAAVDLSASGAAVVGGGPWFESMKASSPRRAADAEHGDWMEKHPSALAQFEPLLAAAKGKQIVMFLDYDGTLSPIVEDPDRAVMSEEMREAVRRVAEHFPTAIVSGRCRDKVLNFVKLTELYYAGSHGMDIQGPAACRQPNHVQQVVHTQAEAAAVHYQAASEFLPVIEEVFRTLTAKMESIAGARVEHNKYCLSVHFRCVREEEWNAVNEEVRSVLREYPNLKLTHGRKVLEIRPSIKWDKGKALEFLLKSLGYAGRNDVFPIYIGDDRTDEDAFKVLRNMGQGIGILVSKLPKETAASYSLSDPAEVKEFLRKLANNKGARQP

SEQ ID NO: 348 - DNA, 1095 bp, Zea mays
ttcagccgaggcaaatggtaaacaacagcaggcatgcatgatgaacaagagagatggaaaccaaaaaaaaaacgaaaatacaaaagggctctactgtactactagctaggtctgttcttgtcccaaagcaagctgctcgatggagatgcagttgcaacaacaaggaagccctctgccggtgcagcaggtaggtagccgaggttgagttagcggcttgacacaggcggatcggagctggtcacggcgggaaagggaaacgaatcgcgggccggatcatcagctgtcgtcgttggcgccgacgagcttgcgcaggaactccttgacctcggcggggtcgcgtagcgtgaaggacgcgctggtgtccttggggaacctggacacgaggatcccggcgccgtgcccgcgcgcgcgcagcaccctgaaggcgtcctcgtcggtgcggtcgtcgccgacgtagatggggaagacgtcgtcgcggtcggcgtcggcggcgaagccgagggcgtggagcaggaactccagcgccttgcccttgtcccagcggatcatggggcggacctccagcaccttgcggccctgggtgaggcgcaggcccgggtggtccctcagcacggcgcggacctgctcgaagagcgcggcccagcacgcctcctccacgcaacggaagtggaccgacaggcagaacttgttgtcctccaccttggcgcccgggatggcgcgctccaccttggccaccagcgccgcgtacacctcctgcatcaccggcaggaactcgctcgccggctggcagagcaccgcctccgcctccgcctccgccttgccgttgccgtggtggtggttggcgtcggcggtgggcccccggatgtccatcccgtggctcccggcgtagtagagctccgctagccgcacgaagctgaacaccttgtcccggcaccgcccgctgacgatcgctgtcgggaagcgcgccgccacgccgcgcaccgcgtccctcatctcgtccgtcatgacggcgcggtcggggtcctccacgatcggggacagcgtgccgtcgtagtccaggaacaccgcgacctgcttccccttggccgccgccgc

SEQ ID NO: 349 - protein, 364 aa, Zea mays
MTKHGVVIGPEDVAAARHFSFPPPRTAAGGESCRKLAAQVDLGPAVVGSWLDSMKASSPRHRLMAPVPGAADAEHDDWMERHPSALDRFDALAAAAKGKQVAVFLDYDGTLSPIVEDPDRAVMTDEMRDAVRGVAARFPTAIVSGRCRDKVFSFVRLAELYYAGSHGMDIRGPTADANHHHGNGKAEAEAEAVLCQPASEFLPVMQEVYAALVAKVERAIPGAKVEDNKFCLSVHFRCVEEACWAALFEQVRAVLRDHPGLRLTQGRKVLEVRPMIRWDKGKALEFLLHALGFAADADRDDVFPIYVGDDRTDEDAFRVLRARGHGAGILVSRFPKDTSASFTLRDPAEVKEFLRKLVGANDDS

SEQ ID NO: 350 - DNA, 1083 bp, Zea mays
atgacgaagcgcaccgccttcgccgcggacgacgcgatcatcgccgccgccgccgccgtcacgtcgcagcccggccggcggttcacgtcgtacccgccggcgagggcgcgcggcggatgcaggctggccccggcggtggcggcggcggcgcgccaggccacggacgaccccggcgccgctgggtcctggccagaactagtcgtgccgcggcacgccgacttcgacgactggatggagaagcacccgtcggcattggccgcgttcgagtcggtgctggccgccgccaaggggaagaagatcgtcatgttcctcgactacgacggcaccctgtcgccgatcgtcaaggaccccgacagcgccgtcatgtcggaggagatgcgggacgcggtgagaggcgtggccgagcacttcccgacggcgatcgtgagcgggaggtgtagagacaaggtgttcaacttcgtgaagctggcggagctgtactacgccgggagccacggcatggacatcaagggacccacggcgcagtccaagcacagcaaggcaaaggccgaagctgttctgtgccaaccagcgagcgcgttcctgcccgtcattgacgaggcgtaccgcgcgctgacggcgaggacggcgccgatccccggcgcgacggtggagaacaacaagttctgcctctccgtccacttccgctgcgtccaggaggagaaatggcgcgctctggaggagcaggtgcggtcggtgctcaaggagtacccggacctccggctcaccaagggcaggaaggtcttggaggtccggccgtccatcaagtgggacaagggcaacgccattcagttcttgctcgagtgtctcggttttgctgacagtaacaatgtcttcccgatatatattggagacgatcgcaccgacgaggacgcgttcaaggtgctgcgcagcatggggcaggggatcggaatcctcgtgagcaagattccaaaggagaccagcgcatcctactccttgcgtgaaccttccgaggtgaaggagttcctgcacaagttggtcaggtccaagcaggcagcagagcagcaggtggtgaaaagctag

SEQ ID NO: 351 - protein, 360 aa, Zea mays
MTKRTAFAADDAIIAAAAAVTSQPGRRFTSYPPARARGGCRLAPAVAAAARQATDDPGAAGSWPELVVPRHADFDDWMEKHPSALAAFESVLAAAKGKKIVMFLDYDGTLSPIVKDPDSAVMSEEMRDAVRGVAEHFPTAIVSGRCRDKVFNFVKLAELYYAGSHGMDIKGPTAQSKHSKAKAEAVLCQPASAFLPVIDEAYRALTARTAPIPGATVENNKFCLSVHFRCVQEEKWRALEEQVRSVLKEYPDLRLTKGRKVLEVRPSIKWDKGNAIQFLLECLGFADSNNVFPIYIGDDRTDEDAFKVLRSMGQGIGILVSKIPKETSASYSLREPSEVKEFLHKLVRSKQAAEQQVVKS

SEQ ID NO: 352 - DNA, 1155 bp, Zea mays
atgccgatggcgaagccgagcgtggcggtggcggaggcttccggcgtcccagcgcaggcgtcgtgctcgtgcccctgcccggggacgacgctgttcccgtacccgccgccgcgcggcgccagcgggatcgcagccgccgccgtgcgccgcaagtgcttgcaggcggaggtgggcggcggcgcctgctggggcgtggagtccatgcgggcgtcgtcgcccacgcacgccagggccgcagccgcgctcgccggcgccggcgccgacgaggaggaggagcgcgccgcctggatggcgcggcacccgtcggcgctgggcaagttcgagaggatcgtggcggcgtccgagggcaggcgcatcgtcatgttcctggactacgacggcacgctgtcgcccatcgtggacgaccccgacgccgccttcatgagcgagacgatgcggatggccgtgcgtagcgtcgccaagcatttcccgacggcgatcgtgagcggccggtgccgcgacaaggtgttcgggttcgtgaagctggcggagctctactacgccggcagccacggcatggacatcaagggtccggccaaggcctcttcttcccggcacgagaaggccaaggcaaaaggagtcctgttccaaccggcaacggcgagcgagttcctgcccatgatagaggctgtgcacgagcgcctggtagagacgacgcgcagcatacccggggccaaggtggagaacaacaggttctgcgtctccgtccacttcagatgcgtcgacgaaaagatgtggggcgagctgtgggagtcggtgaagggcgttctgcgggagtaccccaggctgcggctgacgcaggggcggatggtgctggaggtgcggcccaccatcaagtgggacaagggcaaggcgctcgagttcctgctcgagtcgctcggcttcgcgggctgcaccaacgtcctgcccgtgtacatcggcgacgaccgcaccgacgaggacgccttcagggcgctgcggcgccggggccagggccaaggcgtcggcatcctggtgtccaagcaccccaaggagaccagcgcctcctactcgctccaggagcccgccgaggtgatggagttcttgctgcggctcgtcgagtggaagcgcctctccaggctgagtcggacgcaatga

SEQ ID NO: 353 - protein, 384 aa, Zea mays
MPMAKPSVAVAEASGVPAQASCSCPCPGTTLFPYPPPRGASGIAAAAVRRKCLQAEVGGGACWGVESMRASSPTHARAAAALAGAGADEEEERAAWMARHPSALGKFERIVAASEGRRIVMFLDYDGTLSPIVDDPDAAFMSETMRMAVRSVAKHFPTAIVSGRCRDKVFGFVKLAELYYAGSHGMDIKGPAKASSSRHEKAKAKGVLFQPATASEFLPMIEAVHERLVETTRSIPGAKVENNRFCVSVHFRCVDEKMWGELWESVKGVLREYPRLRLTQGRMVLEVRPTIKWDKGKALEFLLESLGFAGCTNVLPVYIGDDRTDEDAFRALRRRGQGQGVGILVSKHPKETSASYSLQEPAEVMEFLLRLVEWKRLSRLSRTQ

SEQ ID NO: 354 - DNA, 1068 bp, Zea mays
ccgttgcctgctctccttggaccagctgaccaacttgcgcaggaactcctccacctcagaaggttcacgcagggagtaggatgcgcgggtctccttcggaatcttgctcaccaggatcccgatcccttgccccaagttgcgcaggaccttgaacgcgtcctcgtcggtgctatcgtctccgatatatatcgggaagacactgttactgccagcaaaaccgagagactcgagcaagaactgcagggcgttgcccttgtcccacttgatggacggccggatctcgaggaccttcctgcccttggtgaggcggaggtccgggtactccttgagcaccgaccggacctgctcctccagagcgcgccatttctcctcctggacgcagcggaagtggacggagaggcagaacttgttgttctccaccgtcgcgccggggatcggcgccgtgctcgccgtcagcgcgcggtacacctcctcaatgaccggcaggaacgccctcgcaggttggcatagaacggctccggcctttgccttagtgtgcttggactgtgttgtggggcccttgatgtccatgccgtggctcccggcgtagtacagctccgccagcttcacgaagttgaacaccttgtctctacacctcccgctcacgatcgccgtcgggaagtgctcggccacgcctctcaccgcgtcccgcatctcctcggacatgacggcgctgtcggggtccctgacgatcggcgacagggtgccgtcgtagtcgaggaacatgacgatcttcttgcctttggcggcggccagcaccgactcgaacgcggccaatgccgacgggtgcttctccatccagtcgtcgaagtcggcgtgccgcggcacgactagttctggccaggacacagcggcgccgggatcgtccgtggcctggcgcgccgccgccgccggggccagcctgcagccgccgcgcgccctcgccggcgggtacgacgtgaaccgccggccgggctgcgacgtgatggcggcggcggcggcgatgatcgcgtcgtccgcggcgaaggcggtgtgcttcgtcattgcgcg

SEQ ID NO: 355 - protein, 355 aa, Zea mays
MTKHTAFAADDAIIAAAAAITSQPGRRFTSYPPARARGGCRLAPAAAARQATDDPGAAVSWPELVVPRHADFDDWMEKHPSALAAFESVLAAAKGKKIVMFLDYDGTLSPIVRDPDSAVMSEEMRDAVRGVAEHFPTAIVSGRCRDKVFNFVKLAELYYAGSHGMDIKGPTTQSKHTKAKAGAVLCQPARAFLPVIEEVYRALTASTAPIPGATVENNKFCLSVHFRCVQEEKWRALEEQVRSVLKEYPDLRLTKGRKVLEIRPSIKWDKGNALQFLLESLGFAGSNSVFPIYIGDDSTDEDAFKVLRNLGQGIGILVSKIPKETRASYSLREPSEVEEFLRKLVSWSKESRQRD

SEQ ID NO: 356 - protein, 266 aa, Escherichia coli
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRRAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 357 - protein, 896 aa, Saccharomyces cerevisiae
MTTTAQDNSPKKRQRIINCVTQLPYKIQLGESNDDWKISATTGNSALFSSLEYLQFDSTEYEQHVVGWTGEITRTERNLFTREAKEKPQDLDDDPLYLTKEQINGLTTTLQDHMKSDKEAKTDTTQTAPVTNNVHPVWLLRKNQSRWRNYAEKVIWPTFHYILNPSNEGEQEKNWWYDYVKFNEAYAQKIGEVYRKGDIIWIHDYYLLLLPQLLRMKFNDESIIIGYFHHAPWPSNEYFRCLPRRKQILDGLVGANRICFQNESFSRHFVSSCKRLLDATAKKSKNSSNSDQYQVSVYGGDVLVDSLPIGVNTTQILKDAFTKDIDSKVLSIKQAYQNKKIIIGRDRLDSVRGVVQKLRAFETFLAMYPEWRDQVVLIQVSSPTANRNSPQTIRLEQQVNELVNSINSEYGNLNFSPVQHYYMRIPKDVYLSLLRVADLCLITSVRDGMNTTALEYVTVKSHMSNFLCYGNPLILSEFSGSSNVLKDAIVVNPWDSVAVAKSINMALKLDKEEKSNLESKLWKEVPTIQDWTNKFLSSLKEQASSNDDMERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 358 - DNA, 1107 bp, Arabidopsis thaliana
atggatttaaactcaaaccacaaatcctctgttcttaaagatccttcaccatcagttaaccaatcaagactcggcgtgtctagtagatttatgatgagtcaatggaagaaacctgcgaaactcgatgatgttagatccaatggttggttagatgcaatgatttcatcttctccaccgcgtaagaagcttgtcaaagattttaatgttgaagttgctcctgaagatgattttgctcaacgtgcttggatggtgaaatatccttcggcgattagctcgtttgcgcatattgcagctcaagcaaagaagaaaaagattgctgtatttctagattatgatggtactctttctccaatagttgatgatcctgatcgtgccatcatgtctgatgcaatgcgttctgcggttaaagatgtcgcgagttacttcccaaccgcaataattagcggtagaagccgtgacaaggtttatcagttggtaggactaacagaactttattacgcgggtagtcatggaatggacataatgacttcttctgatggtccgaattgtttcaaatccactgaccaacagggtaaggaagtgaatctgtttcagcccgcgagagaattcataccggttatcgacgaggtttttagaacccttgttgagaaaatgaaagatatcaaaggtgcaaaagtagagaaccacaagttctgtgcatctgtacattaccgtaacgttgacgaaaaggattggcctattattgctcagcgtgttcatgaccacttgaaacaataccctcgtttgcgtctaactcatgggaggaaggttttagaggttcgtcctgtgatagactggaacaaaggaagagcggtcgagtttctattagaatctctcggattaagcaataaagacgatttgcttcctatctacattggtgatgacacaaccgatgaagatgcgttcaaggtactgagagatgggaaccgaggtttcggcatcctagtatcgtctataccgaaagaaagcaatgcgttttactcccttagagatccatccgaggtgaagaagtttctaaagactttggtgaaatgggcaaagttggagaagaattctactggtttttga

SEQ ID NO: 359 - protein, 368 aa, Arabidopsis thaliana
MDLNSNHKSSVLKDPSPSVNQSRLGVSSRFMMSQWKKPAKLDDVRSNGWLDAMISSSPPRKKLVKDFNVEVAPEDDFAQRAWMVKYPSAISSFAHIAAQAKKKKIAVFLDYDGTLSPIVDDPDRAIMSDAMRSAVKDVASYFPTAIISGRSRDKVYQLVGLTELYYAGSHGMDIMTSSDGPNCFKSTDQQGKEVNLFQPAREFIPVIDEVFRTLVEKMKDIKGAKVENHKFCASVHYRNVDEKDWPIIAQRVHDHLKQYPRLRLTHGRKVLEVRPVIDWNKGRAVEFLLESLGLSNKDDLLPIYIGDDTTDEDAFKVLRDGNRGFGILVSSIPKESNAFYSLRDPSEVKKFLKTLVKWAKLEKNSTGF

SEQ ID NO: 360 - DNA, 1134 bp, Arabidopsis thaliana
atggatttgaatataaacaagacgacccctgttcttagtgaccctactacaccagtaagtaaaacaagacttggatcatccttcccttcagggagattcatgatgaattctagaaagaagattcctaaactcgatgatgttcgatctaacggttggttggacgcgatgatatcttcgtctccaccgcgtaaaaggcttgtcaaggatttcaatattgagattgctcctgaagatgatttttctcaacgggcctggatgctcaagtatccttcagcgattacctcgtttgcgcatattgcagctcaagcaaagaacaagaagatagctgtgtttctagattatgatggaacactttctccaatagtcgatgaccctgatcgcgccatcatgtctgatgcgatgcgtgctgctgtgaaagatgtcgccaagtacttcccaacagcaataattagtggtagaagccgtgacaaggtttaccaattggtagggctaaccgaactctattacgcgggtagtcacgggatggacattatgactcctgtaaatccaaatggatcccctgaagaccctaattgtataaaaaccactgaccaacagggtgaggaggtaaacctctttcagcctgctaaagagttcatacccgtcattgaagaggtttataataacctcgttgagataactaaatgtatcaaaggtgcaaaagtagagaaccataagttttgtacttctgtacattaccgtaatgttgacgagaaggactggccacttgttgctcaacgcgttcatgaccacctgaaacgataccctcgtttgcgtataactcacggtagaaaggttttagaggtgcgtcctgtgattgagtggaacaaaggaaaagcagtagagtttctgttagagtctctcggattaagcaacaacgatgagttcctcccaatcttcatcggagatgacaagaccgatgaagatgcattcaaggtactgagggaagggaacagaggatttggaatattggtatcgtctgtaccaaaagaaagcaatgcattttactctcttagagacccttccgaggtgaagaagtttctcaagactttggtgaaatgggggaagatggaaagttcaaaaacaagtttttga

SEQ ID NO: 361 - protein, 377 aa, Arabidopsis thaliana
MDLNINKTTPVLSDPTTPVSKTRLGSSFPSGRFMMNSRKKIPKLDDVRSNGWLDAMISSSPPRKRLVKDFNIEIAPEDDFSQRAWMLKYPSAITSFAHIAAQAKNKKIAVFLDYDGTLSPIVDDPDRAIMSDAMRAAVKDVAKYFPTAIISGRSRDKVYQLVGLTELYYAGSHGMDIMTPVNPNGSPEDPNCIKTTDQQGEEVNLFQPAKEFIPVIEEVYNNLVEITKCIKGAKVENHKFCTSVHYRNVDEKDWPLVAQRVHDHLKRYPRLRITHGRKVLEVRPVIEWNKGKAVEFLLESLGLSNNDEFLPIFIGDDKTDEDAFKVLREGNRGFGILVSSVPKESNAFYSLRDPSEVKKFLKTLVKWGKMESSKTSF

SEQ ID NO: 362 - DNA, 1158 bp, Arabidopsis thaliana
atggacatgaaatctggtcactcgtctcctgtaatgactgattctccaccaataagcaactcaagattaaccattcgtcagaatagacttccttactcatcagcagcagccacggctatctcacagaacaacaatctcttactaaccgttccaagaaagaaaactgggatccttgatgatgttaagtctaatggttggcttgatgcgatgaaatcttcttctcctcctcctacaatacttaacaaagataacttaagcaatgatgctacggatatgacttatcgcgaatggatgcagctcaagtatccatcagctcttacctcttttgagaaaatcatgagttttgcaaaaggcaaaagaatagcattgtttcttgattatgacgggacactttcgcctattgttgaggaacctgattgtgcatacatgtcaagtgctatgcgtagtgcagtgcaaaatgttgccaagtatttccctaccgcgatcattagtggaagaagccgggataaggtgtatgagtttgttaatttgagtgaactttattacgccggaagccatggaatggacatcatgagtcccgcaggagaatctttaaaccatgaacatagccgtactgtatcagtttacgaacaggggaaagatgtaaatctattccagcctgctagcgagtttctcccgatgatcgataaggtgctttgttctcttatagagagtacaaaagatatcaaaggggtaaaagtagaagacaacaagttctgcatctctgtgcattaccgcaatgtagaagaaaagaactggacattggttgcacagtgtgtagatgatgtcatcagaacatatccaaaactacggctaacacatggccggaaggttttagagatccgtcctgtgattgactgggacaaagggaaagctgtgacatttctacttgaatcactcggcctaaacaactgtgaggatgttcttccaatctatgttggggatgatcgaacagacgaagatgcatttaaggtactacgagatggaccaaaccacggttatggtatattagtctctgctgtgcctaaagacagcaatgccttttactcgcttcgtgacccgtctgaggtgatggagtttctgaagtcattggtgacatggaagagatcaatgggttaa

SEQ ID NO: 363 - protein, 385 aa, Arabidopsis thaliana
MDMKSGHSSPVMTDSPPISNSRLTIRQNRLPYSSAAATAISQNNNLLLTVPRKKTGILDDVKSNGWLDAMKSSSPPPTILNKDNLSNDATDMTYREWMQLKYPSALTSFEKIMSFAKGKRIALFLDYDGTLSPIVEEPDCAYMSSAMRSAVQNVAKYFPTAIISGRSRDKVYEFVNLSELYYAGSHGMDIMSPAGESLNHEHSRTVSVYEQGKDVNLFQPASEFLPMIDKVLCSLIESTKDIKGVKVEDNKFCISVHYRNVEEKNWTLVAQCVDDVIRTYPKLRLTHGRKVLEIRPVIDWDKGKAVTFLLESLGLNNCEDVLPIYVGDDRTDEDAFKVLRDGPNHGYGILVSAVPKDSNAFYSLRDPSEVMEFLKSLVTWKRSMG

SEQ ID NO: 364 - DNA, 1170 bp, Glycine max
atggacttgaagtcgaatcatactcctgttctcactgatgctgcacctgtaacaaagtctagactgggtgtgcattccagtttgttgccttactcccatactgggacaacctttacacatggaatgttattgactatcccgaggaagaagacaggaattcttgaagatgttcgttgtagtggttggttggatgccatgaaatcatcttcacctccagccaggaagataacaaaggatgttggtcttgggtttgcatcatctgattctgatactgctggtgctttatttagctggctgctaaaatacccatccgcacttgcatcttttgatcaaatcatgaactatgcaaaagggaaaagaattgcgttgtttatggattatgatggaactctttcaccgattgtggataatcctgactgtgctttcatgtccgacaatatgcgtgctgctgttaagaaggtggcagaatattttccaacggcaataattagtggaagaagtcgtgataaggtatatcaatttgtaggactaacagaactttattacgctggtagtcatggaatggacatcattggccctgttagacaatctgtatctgataatcacctaaattgcattaggtctacagacaagcagggtaaggaagtaaatttattccaacctgctgctgaatttctgcccatgattaatgaggtacttaattctcttgaagagtgtacaaaagacattaaaggagctaaagttgagaacaataaattttgtgtatctgtgcactaccggaatgtagatgaaaagtattggaattgggtggggcaacgtgttcatgatgttctgaagggctatccacgtttgcgcttaactcatgggcggaaggttttagagatccgacctgtgattaactgggataagggcaaagctgtcacgtttctacttgagtcacttgggctaaacaattgtgatgatgtgcttcctatatatattggagatgatcggacagacgaagatgcatttaaggttttgagagagggaaataaaggttatgggatcttggtgtcttcagcaccaaaagaaagcaacgcaatttactctcttcgtgatccatcagaggtcatggaatttctcaagtcacttgtgttgtggaaatcaagcaccttaaaaagccttatatag

SEQ ID NO: 365 - protein, 389 aa, Glycine max
MDLKSNHTPVLTDAAPVTKSRLGVHSSLLPYSHTGTTFTHGMLLTIPRKKTGILEDVRCSGWLDAMKSSSPPARKITKDVGLGFASSDSDTAGALFSWLLKYPSALASFDQIMNYAKGKRIALFMDYDGTLSPIVDNPDCAFMSDNMRAAVKKVAEYFPTAIISGRSRDKVYQFVGLTELYYAGSHGMDIIGPVRQSVSDNHLNCIRSTDKQGKEVNLFQPAAEFLPMINEVLNSLEECTKDIKGAKVENNKFCVSVHYRNVDEKYWNWVGQRVHDVLKGYPRLRLTHGRKVLEIRPVINWDKGKAVTFLLESLGLNNCDDVLPIYIGDDRTDEDAFKVLREGNKGYGILVSSAPKESNAIYSLRDPSEVMEFLKSLVLWKSSTLKSLI

SEQ ID NO: 366 - DNA, 1116 bp, Oryza sativa
atggatttgagcaatagctcacctgtcatcaccgatccggtggcgatcagccagcagttgttgggcggcctgccttcaaatctgatgcagttttcagtcatgcccggtggctactccagctctggcatgaacgttggtgtcagtaggctcaaaatcgaggaagtccttgtcaatggactgcttgatgccatgaaatcctcgtcacctcgcaggaggctgaatgtagcatttggcgaggacaattcatctgaagaagaagaccctgcttacagcgcttggatggcaaaatgtccttctgctttggcttccttcaagcaaattgtagccagtgcacaagggaagaagattgctgtgtttctagactatgacggcacactgtcgcctattgtggatgatcctgacaaagcagtgatgtctcccgtgatgagagctgctgtgagaaatgttgcgaagtacttccccactgcaattgtcagcggaaggtcccgcaataaggtgtttgaatttgtaaaactgaaggagctttattatgctggaagccatggtatggacataatggcaccttcagcaaatcatgagcacagtgctgaaaagagcaaacaggccaatctcttccaacctgcacacgactttctgccaatgatcgatgaggttaccaagtccctcttgcaagttgtcagtggaattgaaggtgcaactgttgagaacaacaaattctgcgtttctgtacattatcgcaacgttgcagagaaggattggaaactggtcgcacggctcgtaaacgaagtgctggaggcttttcctcgtctcaaagtaaccaatggacgaatggttttagaggttcgtccggtgatcgactgggacaagggaaaggctgtggagtttctgctccagtcactcgggctaaatgactctgaaaatgtgatccccatctacattggagacgacagaactgacgaagacgctttcaaggtacttcgacagcgaaattgcggttatggaatactagtttcacaggttcccaaggaaactgaagccttctactcgctgagagatccatctgaagtgatggagttcctcaatttcttggtgagatggaagaagcactcagtgtga

SEQ ID NO: 367 - protein, 371 aa, Oryza sativa
MDLSNSSPVITDPVAISQQLLGGLPSNLMQFSVMPGGYSSSGMNVGVSRLKIEEVLVNGLLDAMKSSSPRRRLNVAFGEDNSSEEEDPAYSAWMAKCPSALASFKQIVASAQGKKIAVFLDYDGTLSPIVDDPDKAVMSPVMRAAVRNVAKYFPTAIVSGRSRNKVFEFVKLKELYYAGSHGMDIMAPSANHEHSAEKSKQANLFQPAHDFLPMIDEVTKSLLQVVSGIEGATVENNKFCVSVHYRNVAEKDWKLVARLVNEVLEAFPRLKVTNGRMVLEVRPVIDWDKGKAVEFLLQSLGLNDSENVIPIYIGDDRTDEDAFKVLRQRNCGYGILVSQVPKETEAFYSLRDPSEVMEFLNFLVRWKKHSV

SEQ ID NO: 368 - DNA, 1050 bp, Oryza sativa
atgaagatctctgctaactttctgttgaacaactgtgcacgcacctacaccaagaagaaaacactcaagaagtgtaagcgtgaacttgttgaagtcgttgatggacttgtcggggtaatgatgacatcatcgaaccgtgaaaagccagacattgaatctggttacgacggttcgtctgatgaagattccactgagaattctcgtgcagaaatttgtccttctgccttatgtttcttcgaccaaatcgtagctagtgcgcaagacaagaaggttgtgttgtttctagactatgatggcacactttctcctattgtgaatgatccagagaaagcattcatgtcctctgagatgcgtgctactgtgaaaagtgttgcaaagcacttccctacagcaatagttagtgggagatcccgcgacaaggtgtttgattttgtcaagctgactgagatatactatgcagggagtcatggtatggacatactagcatcttttgcagattcagacagtaccatagaaaagaccaaagaaaccaagctttttcaacctgcaaatgagtttctgactatgataactgaggtttccaaatccctgatagaggtcactaaagcgattaagggtgcaacagttgagaacaacaagttttgcgtatctgttcattatcgtaatgtcgacaagaagaactggaagttggtcgcacaggttgtcaacaatgttctaaaagattttcctagtcttaaagtatccactggacggaaggttttagaggttcgtccaatgatcaactgggacaagggaaaagccgtcgagtttttgcttcgatcgcttgagctagatgattctgaaactgttcttcctatctatattggggatgataaaacggatgaagatgcattcaaggtgcttcgcgagcgaaagaatggatgtgggattcttgtttcgcaggtgcccaagaagtctgaagcctttttcatgctgagaggcccatcagaagtagtgatccttcctgtcatgcttaacttttttgctgcccttctgattatgcctagttaa

SEQ ID NO: 369 - protein, 349 aa, Oryza sativa
MKISANFLLNNCARTYTKKKTLKKCKRELVEVVDGLVGVMMTSSNREKPDIESGYDGSSDEDSTENSRAEICPSALCFFDQIVASAQDKKVVLFLDYDGTLSPIVNDPEKAFMSSEMRATVKSVAKHFPTAIVSGRSRDKVFDFVKLTEIYYAGSHGMDILASFADSDSTIEKTKETKLFQPANEFLTMITEVSKSLIEVTKAIKGATVENNKFCVSVHYRNVDKKNWKLVAQVVNNVLKDFPSLKVSTGRKVLEVRPMINWDKGKAVEFLLRSLELDDSETVLPIYIGDDKTDEDAFKVLRERKNGCGILVSQVPKKSEAFFMLRGPSEVVILPVMLNFFAALLIMPS

SEQ ID NO: 370 - DNA, 1080 bp, Oryza sativa
atgggttcctgcggtaacggtagaagctctgaatatgatgatcctgcatcattagagaagatggaggaactggttttacctctgaaattgatgcccttacacaccaatggccggttgtatgacatgaggttgtcctcacctactgctacctgtgtgatcaatagttcatctggttcattcgacccgatctaccgagcttggacgaagaagtatccttcagctctaaatgcctttgaccacattgttgcctatggcaaagggaagaagatagcgctgtttttggactacgacggtacactgtcgccaattgtcgatgaacctgacaatgctatcatgtctgaccagatgcgcgaggtggtgaggaatgctgccttgcatctacccactgcgattatcagtggaaggtctcgtgataaggtgtttgattttgttaaactaacagaattgtactatgctggtagccatggaatggacatcatgggtccagttggggaacatgattcagttactaaccataggagctccattaactcaaatagaaagcagggcaagggagtgaagatcttccaggctggtactgaattcttaccaatgatcaatgaggtttttagattgctcatcgataagacaaaggcaatcgacggtgtgaaaattgagaacaacaagttctgtgtatcggtgcactaccgcaatgttgaggagaagaattggcaacttgtttctcaatgcacaaatgatgtcctaaaagtctaccctcgcctccgattgactcatggacgaaaagttttggaaattcgtccagtgatagactggaacaaggggaaggctgtggagttcttgctggactccctagatctagctagctgtaaaaatgttctccctatttacatcggggatgattgtaccgacgaggatgcttttaaggttcttcgtgacgataaaaggggtttcgggattctggtgtcatctgtaccaaaggattctcatgccctatattctctgattgatccatctgaggttatggaattcttgaaaagactagtgatgtggaagaacgaagaagcatcacataataagtag

SEQ ID NO: 371 - protein, 359 aa, Oryza sativa
MGSCGNGRSSEYDDPASLEKMEELVLPLKLMPLHTNGRLYDMRLSSPTATCVINSSSGSFDPIYRAWTKKYPSALNAFDHIVAYGKGKKIALFLDYDGTLSPIVDEPDNAIMSDQMREVVRNAALHLPTAIISGRSRDKVFDFVKLTELYYAGSHGMDIMGPVGEHDSVTNHRSSINSNRKQGKGVKIFQAGTEFLPMINEVFRLLIDKTKAIDGVKIENNKFCVSVHYRNVEEKNWQLVSQCTNDVLKVYPRLRLTHGRKVLEIRPVIDWNKGKAVEFLLDSLDLASCKNVLPIYIGDDCTDEDAFKVLRDDKRGFGILVSSVPKDSHALYSLIDPSEVMEFLKRLVMWKNEEASHNK

SEQ ID NO: 372 - DNA, 1149 bp, Oryza sativa
atggatttgaagacaagcaactctcctgttattgctgatcctctccctaaattagccttgccatctgctgtgatgacgtacactacacctacgagtttcccctctaccgggctgtacttgaacactccgaaaaagaagcctctgcctggaaagatcgaagaagtccgcgccgctggatggcttgatctcatgctggcctcctcgccacctcgcaagaggcagactaaggactttgccaatgatgttcaagctgacgagcttgatttgctataccgtaattgggtggtgaaccatccatctgctttaacatcatttgaggatattgttaatcttgccagaggtaaaagattggcactgttccttgattatgatggaactctttcaccgattgtggacaatcctgaaaatgcagtaatgtctgacgagatgcgctctgctgtgaagcatgtggcatcactttttcccactgcgatcattagtggaagatctcgtgataaggtttttgactttgtgaaactaactgaactgtattacgctggaagtcatggaatggatatcatggggcctgttaggaagtctgattcgagtggtcagcatgtggaatgtatcaggtccactgattcagagggtaaagaggtcaacctcttccaacctgcaagtgagtttttacctatgattagcgaggtgtacaaaaagctcagtgaaagtattaaggacattgatggtgcaaggatggaagataacaaattctgtgtgtccgttcattaccgcaatgtagcaccacatgactacggagaagttcatcaacgtgtgactgccgtcctgaagaattacccttgtctaaggcttacccatgggagaaaggttcttgaggttcgacctgtgatagactggaacaaggggaaagctgtggaatttttgctggagtcacttggactatgtgggaaagaagatgttcttcctatctatgttggagatgacaagactgatgaggatgcattcaaggttctgaaggcaaacagcattggctttggaattttggtgtcatctgtgcccaaggatactgatgctttctattccgtacgggacccagctgaggtgatggaattcctgaagaaactggcatcttggaaggaggaatccacttaa

SEQ ID NO: 373 - protein, 382 aa, Oryza sativa
MDLKTSNSPVIADPLPKLALPSAVMTYTTPTSFPSTGLYLNTPKKKPLPGKIEEVRAAGWLDLMLASSPPRKRQTKDFANDVQADELDLLYRNWVVNHPSALTSFEDIVNLARGKRLALFLDYDGTLSPIVDNPENAVMSDEMRSAVKHVASLFPTAIISGRSRDKVFDFVKLTELYYAGSHGMDIMGPVRKSDSSGQHVECIRSTDSEGKEVNLFQPASEFLPMISEVYKKLSESIKDIDGARMEDNKFCVSVHYRNVAPHDYGEVHQRVTAVLKNYPCLRLTHGRKVLEVRPVIDWNKGKAVEFLLESLGLCGKEDVLPIYVGDDKTDEDAFKVLKANSIGFGILVSSVPKDTDAFYSVRDPAEVMEFLKKLASWKEEST

SEQ ID NO: 374 - DNA, 1164 bp, Populus tremuloides
atggacctcaaatcaaatcataatgctcctgtgctcactgattctgctcccctaagcaagtcaaggctacgcgggtaccaccatggtttgatgctgccgtactcaccctcaggtgcacctttctcgtcaaatctattactatctattcctaggaggaaaactggagtgcttgatgatgttcgctcctgtggttggctggatgccatgaaatcatcatctcctactcataagaagtttgccaaggatattaaccatgagctttccgcacctgatccagaagttgcctatcgcacctggctgcttaaatatccatctgcgcttgcatctttcgagcaaattgcaaactttgcaaaaggcaagagaatcgccttatttctggattatgatggtactctttcaccaattgttgaaaatcctgacaatgccttcatgtctgctgatatgcgttccattgtaaaggaagtggcaaaatatttcccaacagcaataatcagtggaagaagccgtgacaaggtgtatgagtttgtagggcttacagaactctactatgcgggtagtcatggtatggatatcatgggccctgtcaggcaatctgtatctgacgaccaccgaaattgtatcaagtctacggacaagcagggcaacgaagttaacttattccagcctgcaagagaatttttacctatgattgacgaggtttatagttcccttgtcaggattaccgaagatattaaaggggcaacagttgagaacaataaattctgtgtctctgtacattaccgtaacgttgatcaagataactggaaatcagttggggagcgtgtccaggatgtcataaagaagtatcctcgcctgcgattgactcatgggaggaaggttttagaaatccgtcccgcgatcaattgggacaaggggaaagctcttgaatttctacttgaatcactagatctcagcaattgtgatgatgtgctgccgatttatgttggagatgaccggacagatgaagatgcatttaaggttttgagagagaggaactgtggttatggcatttttgtatcaaaatcaccgaaggaaagcaatgcgtattactctctcagagacccagcagaggtcatggagtttctcaagtccctggtgacatggaagaaatcgagtgctttataa

SEQ ID NO: 375 - protein, 387 aa, Populus tremuloides
MDLKSNHNAPVLTDSAPLSKSRLRGYHHGLMLPYSPSGAPFSSNLLLSIPRRKTGVLDDVRSCGWLDAMKSSSPTHKKFAKDINHELSAPDPEVAYRTWLLKYPSALASFEQIANFAKGKRIALFLDYDGTLSPIVENPDNAFMSADMRSIVKEVAKYFPTAIISGRSRDKVYEFVGLTELYYAGSHGMDIMGPVRQSVSDDHRNCIKSTDKQGNEVNLFQPAREFLPMIDEVYSSLVRITEDIKGATVENNKFCVSVHYRNVDQDNWKSVGERVQDVIKKYPRLRLTHGRKVLEIRPAINWDKGKALEFLLESLDLSNCDDVLPIYVGDDRTDEDAFKVLRERNCGYGIFVSKSPKESNAYYSLRDPAEVMEFLKSLVTWKKSSAL

SEQ ID NO: 376 - DNA, 1077 bp, Populus tremuloides
atggatatcgagtcaaaccattcttctcctgttctcactgatcctgctccaataaacaagtcaaggctcggcatccattctaatttaaaaaagcctgggaaacttgatgaagtctgctcgaacgcatgtctggatgccatgaaatcctcatcaccccctcgcaagaagctcattaaggatggtgctgacacagcttacggcacctggatgctcaagcatccatcagcactcaactcatttgaggaaattgcaaattttgccaaaaacaaaaagatagcaatgtttctagactacgatggtactctctctccaatagtagatgacccagataatgcccttatgtctgatgatatgcgttttgcagtaagaaacttcgcaaaatatttcccaacggcgattattagtggaagaagtcgtgacaaggtttatcagcttgtaggactaacagaattgtattatgctggtagtcatgggatggacatcttgggccctgtacgaaaagcggtgtccaatgaccatccaaactgtaatgaatcaactactgaccaacagggcaaggaggtgaatctgtttcagcctgctagagaatttatacctctgatcgatgaggtttttagaacccttgtcgaggatactaaggggatcaaaggtgcaaaagttgagaatcataaattttgcgtctctgtacatttccgtaatgtagatgagaagaactggcaatctattgcacaatgtgttcaggatattttagataagtatcctcgtttgcgaaaaactcatggacggaaggttttagaggtccgtccaatgattgactggaataaaggaaaagcagttgaatttttgcttgaatctctaggtctaagtaatagagatgatgtactcccaatttatattggtgatgatctgacagatgaagatgcattcaaggtgctccgggaggggaatcgaggctgtggaattttggtgtcatctagacccaaagaaaccaatgcagtttactctctcagagatccatcggaggtgatgaaatttctcaattccctggtgacatggaagaaggtggatgcatcctga

SEQ ID NO: 377 - protein, 358 aa, Populus tremuloides
MDIESNHSSPVLTDPAPINKSRLGIHSNLKKPGKLDEVCSNACLDAMKSSSPPRKKLIKDGADTAYGTWMLKHPSALNSFEEIANFAKNKKIAMFLDYDGTLSPIVDDPDNALMSDDMRFAVRNFAKYFPTAIISGRSRDKVYQLVGLTELYYAGSHGMDILGPVRKAVSNDHPNCNESTTDQQGKEVNLFQPAREFIPLIDEVFRTLVEDTKGIKGAKVENHKFCVSVHFRNVDEKNWQSIAQCVQDILDKYPRLRKTHGRKVLEVRPMIDWNKGKAVEFLLESLGLSNRDDVLPIYIGDDLTDEDAFKVLREGNRGCGILVSSRPKETNAVYSLRDPSEVMKFLNSLVTWKKVDAS

SEQ ID NO: 378 - DNA, 1119 bp, Triticum aestivum
atggatttgagcaacgcctcaccggtcatcagtgatccgatggcaatgagccagtcgttgatgggagtgctgccttccaacatgatgccgttttcagtcaggcccgggggttactccggcgctggtggcgccggcgtaaacgtcagcaggcgcaagatcgaggaggtcctcgtgagcgggctgctggatgccatgaaatcctcgtcgccacgtaagaagcacaacgtggtcttcggccaggaaaacctgcctgaagaagatcctgcctacagtgcatggatggcaaaatgcccctctgctctggcttccttcaagcagatcgtagccagtgcacaaggcaagaagattgcggtcttcttggactacgatggcacactgtcgccgatcgtcgacgaccctgaaaaagccgtcatgtcccctgtgatgagagctgctgtgagaaacgtcgccaaatacttccccgacgccatcgtcagcgaaaggtcccggaagaaggttcttgaattcgtaaaactgaaggaactctgctatgctggaagtcatgggatggacataatgacatcttcttcagcacattatgaacacaatactgaaaagggcaaagaagccaacctcttccaacctgctcgcgattttctgcctatgatcgatgaggtttccaaggccctcttggaagtcacgagcggaatcgaaggcgcgagagttgaggacaacaagttctgcgtgtctgttcattaccgcaacgtagacgagaaggactgggagctggtcgcacggctcgtaaacgaggtgctggaggacttccccactctcaaagtgaccaacgggcgaatggttttagaggttcgtccggtgatcgactgggacaaggggaaggccgtcgagttcctgcttcagtcgctcgggctgagcgactccgagaacgtgatcccaatctacatcggcgacgaccgcaccgacgaagacgcgttcaaggtgcttcgggagaggaactgcggatacgggatactggtctcgcaggcgcccaaggaaaccgaggccttctactcgctcagggacccgtctgaagtgatggagttcctgaactccttggtgagatggaagaagcactcgctatga

SEQ ID NO: 379 - protein, 372 aa, Triticum aestivum
MDLSNASPVISDPMAMSQSLMGVLPSNMMPFSVRPGGYSGAGGAGVNVSRRKIEEVLVSGLLDAMKSSSPRKKHNVVFGQENLPEEDPAYSAWMAKCPSALASFKQIVASAQGKKIAVFLDYDGTLSPIVDDPEKAVMSPVMRAAVRNVAKYFPDAIVSERSRKKVLEFVKLKELCYAGSHGMDIMTSSSAHYEHNTEKGKEANLFQPARDFLPMIDEVSKALLEVTSGIEGARVEDNKFCVSVHYRNVDEKDWELVARLVNEVLEDFPTLKVTNGRMVLEVRPVIDWDKGKAVEFLLQSLGLSDSENVIPIYIGDDRTDEDAFKVLRERNCGYGILVSQAPKETEAFYSLRDPSEVMEFLNSLVRWKKHSL

SEQ ID NO: 380 - DNA, 1110 bp, Zea mays
atggatatgggcagcggctcgtcacctgtcatcaccgatccgatatcgataagcccaccgctgctgggaggcttgacgtcgaacctgatgccgttctcggtcatgtccggaggctgctcctccagtcctagcatgagcgccagcagcaggcgtaaaatcgaggaggtccttgtcaatggcctgctagacgcgatgaaatcgtcgtcgcctcgcaagaagcacaacctcgccttcggacaggataattcgcccgacgaagatcctgcttacactgcatggctgtcaaaatgcccttctgcgctggcctccttcaagcagatagtagccaacgcacagggcaggaggatcgctgtgttcttggattacgacggcaccctgtcgccgatcgtcgacgatcccgacaaagcgttcatgtcccctgtgatgagagctgctgttagaaatgtcgcgaagtacttccctaccgcgattgtcagcggaaggtcccgtaagaaggtgtttgaatttgtaaaactgacggaactgtactacgctggtagtcacgggatggacatagtgacatctgcagcagcacatgctactgaaaagtgcaaagaagccaatctcttccaacctgcttgcgagtttctccctatgattaatgaggtttccaagtgcctcgtggaggtcacgagttcaattgaaggtgcaagagttgagaacaacaagttctgtgtatctgtacattaccgcaacgtagcagagaaggactggaaagtggtcgcaggactcgtgaaacaagtcttggaggccttccctcgtctcaaagtaaccaacgggcgaatggttttagaggttcgcccggtgatcgactgggacaagggaaaggctgtcgagttcctgcttcggtcgctcggcctaagcgactccgaagatgtggttcctatctacatcggagacgatcgaacagacgaagacgccttcaaggtactgcgagagcgaagctgtggatacggaatcctagtctcgcaggtgcccaaggacactgaagccttctactcgctgagagacccgtctgaagtgatggggttcctcaattccttggtgagatggaagaagcacccgctgtga

SEQ ID NO: 381 - protein, 369 aa, Zea mays
MDMGSGSSPVITDPISISPPLLGGLTSNLMPFSVMSGGCSSSPSMSASSRRKIEEVLVNGLLDAMKSSSPRKKHNLAFGQDNSPDEDPAYTAWLSKCPSALASFKQIVANAQGRRIAVFLDYDGTLSPIVDDPDKAFMSPVMRAAVRNVAKYFPTAIVSGRSRKKVFEFVKLTELYYAGSHGMDIVTSAAAHATEKCKEANLFQPACEFLPMINEVSKCLVEVTSSIEGARVENNKFCVSVHYRNVAEKDWKVVAGLVKQVLEAFPRLKVTNGRMVLEVRPVIDWDKGKAVEFLLRSLGLSDSEDVVPIYIGDDRTDEDAFKVLRERSCGYGILVSQVPKDTEAFYSLRDPSEVMGFLNSLVRWKKHPL

SEQ ID NO: 382 - DNA, 1224 bp, Zea mays
atggatttgaagacaggcctcaattcacctgttattgctgaccatctccctacgttagcattgcctgctgctgtcatgactttcacaacacctactagctttccctctccggggctttgcttgaacactacaaagaagatacctctgcctggtaagattgaagaagttcgtgctgctggatggcttgatctcatgaaggcctcatcacctacccgcaaaaggcagatcaaggatgtcatctgtgatgctcaatctgatcttgatttgcaatactgcaactggacagtgaactatccttctgctttgatctcatttgaggcaattagtgatcttgctgggagtaaaaggttggcattgtttcttgactatgatggaacactttcaccgattgtggacaatcctgaaaatgcattaatgtctgatgagatgcgtgctgcagtgaggcatgcggcatcacttttcccaactgcaatcattagcggaaggtctcgtgataaggtttttgactttgtgaagctaaatgaattgtactacgctggaagccatggaatggacataatgggccctgttaggaagactactgactccaatggcgtggaatgtattcggtcaactgatgtgcatggtaaagaagtcaacctgttccaacctgctagtgagtttttacctatgatcactgaggtatgttgtaccggcctcttgagtttaagttgccatcttatgtcatatggttggacttctgagtggtgtacatgccaggtgtatgaaaaacttggtgagagtgttaaggacattgatggtgcaaggatggaagacaacaagttctgtgtatctgtgcattaccgtaatgtggcggaagatgactataaaaaggttttccatcgtgtaactgctgttttggaaggttacccttgcctaagactaacccatgggaggaaggtttttgaggtccgtcctgttattgattggaacaaaggtaaagctgtggagtttttacttgaatcgcttgggatcagggagagtgaagatgttctgcctatgtatgttggagatgacagaacagatgaagatgcattcaaagttgtgaaggcaagcaacgggggttttggaatattggagtcgtgtagacccaaagagagagaggccttctactccgtgagggatgcagctgaggggagggaatttctgagaatgttggcagcagggaaggagcagtccgggtga

SEQ ID NO: 383 - protein, 407 aa, Zea mays
MDLKTGLNSPVIADHLPTLALPAAVMTFTTPTSFPSPGLCLNTTKKIPLPGKIEEVRAAGWLDLMKASSPTRKRQIKDVICDAQSDLDLQYCNWTVNYPSALISFEAISDLAGSKRLALFLDYDGTLSPIVDNPENALMSDEMRAAVRHAASLFPTAIISGRSRDKVFDFVKLNELYYAGSHGMDIMGPVRKTTDSNGVECIRSTDVHGKEVNLFQPASEFLPMITEVCCTGLLSLSCHLMSYGWTSEWCTCQVYEKLGESVKDIDGARMEDNKFCVSVHYRNVAEDDYKKVFHRVTAVLEGYPCLRLTHGRKVFEVRPVIDWNKGKAVEFLLESLGIRESEDVLPMYVGDDRTDEDAFKVVKASNGGFGILESCRPKEREAFYSVRDAAEGREFLRMLAAGKEQSG

SEQ ID NO: 384 - DNA, 1146 bp, Zea mays
atggatttgaagacaggcctcaattcacctgttattgctgaccatctccctacgttagcattgcctgctgctgtcatgactttcacaacacctactagctttccctctccggggctttgcttgaacactacaaagaagatacctctgcctggtaagattgaagaagttcgtgctgctggatggcttgatctcatgaaggcctcatcacctacccgcaaaaggcagatcaaggatgtcatctgtgatgctcaatctgatcttgatttgcaatactgcaactggacagtgaactatccttctgctttgatctcatttgaggcaattagtgatcttgctgggagtaaaaggttggcattgtttcttgactatgacggaacactttcaccgattgtggacaatcctgaaaatgcattaatgtctgatgagatgcgtgctgcagtgaggcatgcggcatcacttttcccaactgcaatcattagcggaagatctcgtgataaggtttttgactttgtgaagctaaatgaattgtactacgctggaagccatggaatggacataatgggccctgttaggaagactactgactccaatggcgtggaatgtattcggtcaactgatgtgcatggtaaagaagtcaacctgttccaacctgctagtgagtttttacctatgatcactgaggtgtatgaaaaacttggtgagagtgttaaggacattgatggtgcaaggatggaagacaacaagttctgtgtatctgtgcattaccgtaatgtggcggaagatgactataaaaaggttttccatcgtgtaactgctgttttggaaggttacccttgcctaagactaacccatgggaggaaggtttttgaggtccgtcctgttattgattggaacaaaggtaaagctgtggagtttttacttgaatcgcttgggctcagcgagagtgaagatgttctccctatctatgttggagatgacagaacagatgaagatgcattcaaagttctgaaggcaagcaaccgtggctttggaatattggtgtcgtctatacccaaagagagtgacgccttctactccttgagggatccagctgaggtgatggaatttctgagaatgttggcagcatggaaggagcagtccacctga

SEQ ID NO: 385 - protein, 381 aa, Zea mays
MDLKTGLNSPVIADHLPTLALPAAVMTFTTPTSFPSPGLCLNTTKKIPLPGKIEEVRAAGWLDLMKASSPTRKRQIKDVICDAQSDLDLQYCNWTVNYPSALISFEAISDLAGSKRLALFLDYDGTLSPIVDNPENALMSDEMRAAVRHAASLFPTAIISGRSRDKVFDFVKLNELYYAGSHGMDIMGPVRKTTDSNGVECIRSTDVHGKEVNLFQPASEFLPMITEVYEKLGESVKDIDGARMEDNKFCVSVHYRNVAEDDYKKVFHRVTAVLEGYPCLRLTHGRKVFEVRPVIDWNKGKAVEFLLESLGLSESEDVLPIYVGDDRTDEDAFKVLKASNRGFGILVSSIPKESDAFYSLRDPAEVMEFLRMLAAWKEQST

SEQ ID NO: 386 - DNA, 2556 bp, Arabidopsis thaliana
atgatttctaggtcgtacacgaatctgttagacttggcatcagggaatttccctgtcatgggaagagagcgtaggcggcttcctagggtaatgactgttcctggtaatgtctctgagtttgatgaagatcaagcgtatagtgtgtcttccgataatccttcttcggtttcctctgatcgaatgatcattgtggctaaccggctcccattgaaggcggagaaacgaaatggaagctggagttttagttgggatcaagattctctgtatttgcagctcaaggacgggttgcctgaggatatggagattttatatgttggatctttgagcgttgatgttgattcaaatgaacaagacgatgtggcgcagatactgttggacaaatttaaatgtgttcctacgtttttcccacctgatttgcaatcaaagttttacgacggtttttgcaagaggcagatatggccgctttttcactacatgcttccgttttccgctgatcatggtggaagatttgataggtctctttgggaggcttatgtagcgactaacaagctcttcttccagaaagtaattgaggttattaacccagatgatgattttgtctggattcatgactaccatttgatggtcttaccaacttttctgagaaggcggtttaaccggataaggatgggatttttccttcacagtcccttcccctcatctgagatataccggtctcttcctgttcgggaggagatacttaaggcgttactaaacagcgaccttattggctttcacacgttcgattatgctcgtcacttccttacttgctgcagtcggatgttgggtctagaatatcagtctaagagaggttacattgggctggagtattacgggaggactgtgggaatcaagatcatgccagtggggatcaacatgggtcggattcaatcggtgatgagatattcagaagaggagggtaaggtgatggagctcagaaatcgtttcgaaggtaagacagtgttgcttggtatcgatgacatggatattttcaagggtataaacctgaagcttctagcaatggaacaaatgctgaggcagcacccgaattggaggggaagggctgttctggttcagattgtaaatcccgctaggggtaaaggtattgatgtagaggaaatacgtggtgaaatcgaagaaagctgcaggaggatcaatggagagtttgggaaacctggatatcaacctatcatatatattgatactccggtttcgattaatgaaataaatgcttattaccatattgctgagtgcgtggtcgttacagctgttagagatggtatgaaccttactccctacgaatatatcgtttgtagacaaggtttacttgggtctgaatcagactttagtggcccaaagaagagcatgttggttgcatcagagtttattggatgttccccttcgcttagtggggctatacgcgtaaacccatggaacgttgaagctactggagaagcactaaatgaggccctctcaatgagtgatgctgagaaacagctacggcatgagaaacatttccggtatgttagtactcacgatgtagcttattggtcaagaagtttcttgcaagacctagagaggatatgtgtggaccatttcaagaaaaggtgttgggggatggggattagttttggtttcagagttgttgcactcgatcctaattttagaaagctttcaataccgtgcattgtgtcagactacaaaagggcgaaaagcagagcgatactgttggattatgatggcactctgatgcctcaaaactccatcaataaagctccaagccaggaagttcttaactttttggatgcactttgcgaggacaagaagaattcaattttcattgtcagtggaagagggagggaaagtttaagcaagtggttcactccgtgcaaaaaaattggaattgcggcagagcatggatacttcttaaagtggtcaggcagtgaagaatgggagacatgtgggcagagctctgattttgggtggatgcagatcgtggaacctgtaatgaagcagtacactgaatcgactgatggctcttccattgaaatcaaagagagcgctttggtttggcaatatcgggatgcagatccaggctttggttctttacaagcgaaggaaatgctagagcatttagagagtgttctagctaatgagccagtggcagtcaaaagcggtcactacatagtagaagtcaagcctcagggagtgagcaaaggatccgtgtcagaaaagatattttcatcaatggccggaaagggaaaaccggttgatttcgtgttatgtattggagatgacagatctgatgaagacatgtttgaagcgattggtaatgcgatgtcgaaaaggttactctgtgataatgctctagtctttgcatgcacagttgggcaaaagccaagcaaggctaaatactacttggacgatactactgaagtgacatgcatgcttgaatctctagctgaagcatcagaggcttcaaacttttctatgcgtgaacttgatgaagccctttga

SEQ ID NO: 387 - protein, 851 aa, Arabidopsis thaliana
MISRSYTNLLDLASGNFPVMGRERRRLPRVMTVPGNVSEFDEDQAYSVSSDNPSSVSSDRMIIVANRLPLKAEKRNGSWSFSWDQDSLYLQLKDGLPEDMEILYVGSLSVDVDSNEQDDVAQILLDKFKCVPTFFPPDLQSKFYDGFCKRQIWPLFHYMLPFSADHGGRFDRSLWEAYVATNKLFFQKVIEVINPDDDFVWIHDYHLMVLPTFLRRRFNRIRMGFFLHSPFPSSEIYRSLPVREEILKALLNSDLIGFHTFDYARHFLTCCSRMLGLEYQSKRGYIGLEYYGRTVGIKIMPVGINMGRIQSVMRYSEEEGKVMELRNRFEGKTVLLGIDDMDIFKGINLKLLAMEQMLRQHPNWRGRAVLVQIVNPARGKGIDVEEIRGEIEESCRRINGEFGKPGYQPIIYIDTPVSINEINAYYHIAECVVVTAVRDGMNLTPYEYIVCRQGLLGSESDFSGPKKSMLVASEFIGCSPSLSGAIRVNPWNVEATGEALNEALSMSDAEKQLRHEKHFRYVSTHDVAYWSRSFLQDLERICVDHFKKRCWGMGISFGFRVVALDPNFRKLSIPCIVSDYKRAKSRAILLDYDGTLMPQNSINKAPSQEVLNFLDALCEDKKNSIFIVSGRGRESLSKWFTPCKKIGIAAEHGYFLKWSGSEEWETCGQSSDFGWMQIVEPVMKQYTESTDGSSIEIKESALVWQYRDADPGFGSLQAKEMLEHLESVLANEPVAVKSGHYIVEVKPQGVSKGSVSEKIFSSMAGKGKPVDFVLCIGDDRSDEDMFEAIGNAMSKRLLCDNALVFACTVGQKPSKAKYYLDDTTEVTCMLESLAEASEASNFSMRELDEAL

SEQ ID NO: 388 - DNA, 2604 bp, Arabidopsis thaliana
atggtgtcaagatcttgtgcaaattttctagatttagcatcttgggacttattggactttcctcaaactcaaagagctcttcctcgtgtcatgactgttcctggtatcatctctgagttggatggaggctacagtgatggatcctctgatgttaattcctcaaacagctcccgtgagcggaagattatagtggctaatatgttaccattacaagctaagagagatacagaaactggacaatggtgttttagttgggatgaagattctcttctcttgcaactcagagatgggttttcttcggatacagagtttgtttatataggatcacttaatgctgatattggtattagtgaacaagaagaagtttctcataagcttttgttggatttcaattgtgttcctacgtttttacccaaggagatgcaagagaagttctatcttggtttctgtaaacatcatttgtggccgctatttcactatatgcttcctatgttccctgaccatggtgatcgttttgaccggcgtctttggcaagcgtatgtctctgcaaacaagatattttcagatagggtgatggaagttatcaaccctgaggaagattatgtttggattcatgattatcatctgatggttcttcccacattcttgaggaaacggtttaacaggatcaagcttggatttttccttcacagtccatttccatcatcagaaatttaccgtactttgccagtccgggatgatcttttgagaggattgttgaactgtgatctcattggcttccacacatttgattatgcacgccattttttgtcatgctgcagtagaatgcttgggcttgattatgaatctaagcgtgggcacatcgggcttgattactttggtcgaacggtgtttattaagatccttcctgttggcatccatatggggaggctggaatcggttttgaatcttccgtcgactgcagcgaaaatgaaagagatacaagaacagtttaaggggaaaaagttgattcttggtgttgacgacatggacatctttaaaggcataagcctcaaacttatagccatggaacgtctctttgagacatattggcatatgcgaggaaaacttgtcctgattcagatagtgaacccagcacgggccacgggtaaggatgtggaagaagcaaagaaggagacatattcaactgcaaaaaggatcaatgagcgctatggttctgctggttatcagccagtgatcttgattgatcgtcttgttcctcgttacgagaagactgcttattatgctatggcagactgctgcctggtgaatgcagtaagagacggcatgaacttagttccatataaatatatcatttgcaggcaagggaccccaggaatggataaggccatggggattagccatgactcagcccggacgagcatgcttgttgtctctgagtttatcggctgctcgccttctttgagtggtgcgatcagggtgaacccatgggatgtagatgctgttgcagaagcggtaaacttagccctcactatgggtgagactgaaaagcgattaaggcacgagaaacactatcactatgtgagtactcatgatgtgggttactgggcaaagagctttatgcaggatcttgagagggcatgccgggagcattataataaacgttgttggggtattggttttggcttgagtttcagagttctgtcactgtctccgagttttaggaagctatctatcgatcacattgtctccacgtatagaaatacacagagaagggcaatatttttggactatgatggcactctcgttcctgaaagctccatcatcaaaacccctaatgccgaagtcctgtctgttctgaaatctctgtgtggagatcctaaaaacactgtgtttgttgtcagtggaagaggatgggagtctctgagcgactggctatctccatgtgaaaatcttggaatcgcagctgaacacggatacttcataaggtggagtagcaagaaagaatgggagacttgttattcgtcggctgaggcggaatggaagacgatggtagaaccggtaatgagatcatacatggacgcaaccgatggttctactatagagtacaaagagagtgctttggtttggcatcatcaagacgcagatccagactttggagcctgtcaagcaaaagagcttctagatcatctagagagtgtactcgcaaatgagcctgtagtcgtcaagagaggccaacacattgtagaggtcaaaccacagggagtaagcaaaggtctagcagtggaaaaggtgatacaccaaatggtagaggatggaaacccaccggacatggtgatgtgtataggagatgacagatcagacgaagacatgtttgagagcatattgagcacagtgacaaacccggacctcccaatgccacctgagatctttgcctgcacggtgggaagaaaaccaagcaaagccaaatacttcttagacgatgtctctgatgtattaaagctcctaggaggattagctgctgcaacgagcagctcgaagccagagtatcaacaacaatcctcctcattgcacacgcaagtggcgtttgagagcatcatatga

SEQ ID NO: 389 - protein, 867 aa, Arabidopsis thaliana
MVSRSCANFLDLASWDLLDFPQTQRALPRVMTVPGIISELDGGYSDGSSDVNSSNSSRERKIIVANMLPLQAKRDTETGQWCFSWDEDSLLLQLRDGFSSDTEFVYIGSLNADIGISEQEEVSHKLLLDFNCVPTFLPKEMQEKFYLGFCKHHLWPLFHYMLPMFPDHGDRFDRRLWQAYVSANKIFSDRVMEVINPEEDYVWIHDYHLMVLPTFLRKRFNRIKLGFFLHSPFPSSEIYRTLPVRDDLLRGLLNCDLIGFHTFDYARHFLSCCSRMLGLDYESKRGHIGLDYFGRTVFIKILPVGIHMGRLESVLNLPSTAAKMKEIQEQFKGKKLILGVDDMDIFKGISLKLIAMERLFETYWHMRGKLVLIQIVNPARATGKDVEEAKKETYSTAKRINERYGSAGYQPVILIDRLVPRYEKTAYYAMADCCLVNAVRDGMNLVPYKYIICRQGTPGMDKAMGISHDSARTSMLVVSEFIGCSPSLSGAIRVNPWDVDAVAEAVNLALTMGETEKRLRHEKHYHYVSTHDVGYWAKSFMQDLERACREHYNKRCWGIGFGLSFRVLSLSPSFRKLSIDHIVSTYRNTQRRAIFLDYDGTLVPESSIIKTPNAEVLSVLKSLCGDPKNTVFVVSGRGWESLSDWLSPCENLGIAAEHGYFIRWSSKKEWETCYSSAEAEWKTMVEPVMRSYMDATDGSTIEYKESALVWHHQDADPDFGACQAKELLDHLESVLANEPVVVKRGQHIVEVKPQGVSKGLAVEKVIHQMVEDGNPPDMVMCIGDDRSDEDMFESILSTVTNPDLPMPPEIFACTVGRKPSKAKYFLDDVSDVLKLLGGLAAATSSSKPEYQQQSSSLHTQVAFESII

SEQ ID NO: 390 - DNA, 2586 bp, Arabidopsis thaliana
atggggtcaaaatcatttggaaatctattagacttggcctctggggatcttttggacattcctcagactccgagatatcttccaagagtgatgactgttcctggcattatctctgacgttgatggatatggaattagtgatggcgattcagatgtcatttcattaccttgccgtgagcggaaaatcattgtggccaattttcttcctttgaatggtaaaaaggattcagaaactggaaagtggaaattcagtctcgacaatgattctcccctgttacatctcaaggatggtttttctccagagactgaagtcatttatgttggatcgctcaagacgcatgttgatgttagtgagcaagacgaggtttcccataatctttttgaggaattcaattgtgtagcgactttcctcccacaagatgtgcataaaaaattctaccttggcttttgtaaacagcaactatggccacttttccattacatgttacccatgtgtcctgatcatggtgaacggtttgatcgtggtctttggcaggcatatgtttctgccaacaagatatttgcagataaggtaatgggtgtgattaatcttgaagaagattatatctggattcatgactatcatttaatggttctcccaacatttttgagaaggcggtttcacagggttaagcttggtttcttcctccacagtccattcccttcttcagaaatttatcgaaccttacctgttcgagaggaactactaagagggctcttaaattgtgacttaattggttttcacacgtttgattatgcacggcatttcttgtcatgctgctgtagaatgcttggattggagtatgaatctaagagagggcatattgctcttgactacttgggacgtacagtttttctgaagattcttcctataggtattcacatgggaaggctggaatccgttctgaatcttcctgctacagctgaaaagctgaaagagattcaagaaaagtatcggggtaaaaagataattctcggtgttgatgacatggatatattcaaaggtttaagtcttaaaattttggcctttgaacacctccttcagcaatatcctagcatgctagggaaaatagttcttattcagattgtgaacccagccagaggctcaggtaaagacgttcaggaagcgaggaaagaaacgtatgatactgttaaaagaatcaacgagcgttatggttcacatgattatgagccagtggttctgattgatcgccctgttcctcggtttgagaagtctgcctattatgccctggcagaatgctgcatagtcaatgcagtgagggatgggatgaacttagttccgtacaagtacactgtttgtcggcagggaactcctagtatgaataagtctttgggagtaagtgatgatttgcctcgcacaagcacccttgttctgtccgagttcattggttgctcgccttctctaagtggtgcgattagggttaatccttgggacgttgacgcggtagccgattcactatattctgctattaccatgtctgattttgagaagcaactacgacataaaaaacactttcactacattagtacacatgatgtgggttattgggcgcgcagcttttcgcaggatttggagagggcatctcgagatcattacagtaaacggtgctggggtgtgggttggggtttgggtttcaggcttgtcgctctctctcctaatttcagaaggctatccattgagcaaactgttagtgcttacagaagatcgagcaagagagcaatatttcttgattatgatggtactttagttcctgagacctcgattgtaaaggacccaagtgctgaagttatatctgcgttgaaggcactgtgtagtgatcctaacaacactatatttattgttagcgggaggggaaaagtttctttgagcgagtggcttgcgccatgtgagaatcttggaatagcggctgaacatggttactttacaaggtggaataagtcttctgactgggaaacaagcggcttatctgatgaccttgagtggaagaaagttgtggaacctattatgagactttatacagagactactgatggatccaatatagaagcaaaagagagtgctttagtctggcatcaccaagatgctgacccagactttggttcttgtcaagccaaggaactactggaccatctagaaactgttcttgtgaatgaaccagttattgtgaacagaggccaccaaatcgttgaagttaagcctcagggagtaagcaaagggcttgtcaccgggaaaattcttagccgaatgcttgaagatgggatagcgccagattttgtggtatgcattggggatgatagatcagacgaggagatgtttgaaaacatatcaacaaccctctcagctcaatcatcgtcaatgtctacagagatattcgcgtgtactgtgggaagaaaaccgagcaaagccaaatacttcctcgatgaagtaagcgacgtggtgaagttgcttcaaggacttgccaacacttcgagcccaaagcctaggtacccttctcacctcagagtctccttcgaaagcgtggtatga

SEQ ID NO: 391 - protein, 861 aa, Arabidopsis thaliana
MGSKSFGNLLDLASGDLLDIPQTPRYLPRVMTVPGIISDVDGYGISDGDSDVISLPCRERKIIVANFLPLNGKKDSETGKWKFSLDNDSPLLHLKDGFSPETEVIYVGSLKTHVDVSEQDEVSHNLFEEFNCVATFLPQDVHKKFYLGFCKQQLWPLFHYMLPMCPDHGERFDRGLWQAYVSANKIFADKVMGVINLEEDYIWIHDYHLMVLPTFLRRRFHRVKLGFFLHSPFPSSEIYRTLPVREELLRGLLNCDLIGFHTFDYARHFLSCCCRMLGLEYESKRGHIALDYLGRTVFLKILPIGIHMGRLESVLNLPATAEKLKEIQEKYRGKKIILGVDDMDIFKGLSLKILAFEHLLQQYPSMLGKIVLIQIVNPARGSGKDVQEARKETYDTVKRINERYGSHDYEPVVLIDRPVPRFEKSAYYALAECCIVNAVRDGMNLVPYKYTVCRQGTPSMNKSLGVSDDLPRTSTLVLSEFIGCSPSLSGAIRVNPWDVDAVADSLYSAITMSDFEKQLRHKKHFHYISTHDVGYWARSFSQDLERASRDHYSKRCWGVGWGLGFRLVALSPNFRRLSIEQTVSAYRRSSKRAIFLDYDGTLVPETSIVKDPSAEVISALKALCSDPNNTIFIVSGRGKVSLSEWLAPCENLGIAAEHGYFTRWNKSSDWETSGLSDDLEWKKVVEPIMRLYTETTDGSNIEAKESALVWHHQDADPDFGSCQAKELLDHLETVLVNEPVIVNRGHQIVEVKPQGVSKGLVTGKILSRMLEDGIAPDFVVCIGDDRSDEEMFENISTTLSAQSSSMSTEIFACTVGRKPSKAKYFLDEVSDVVKLLQGLANTSSPKPRYPSHLRVSFESVV

SEQ ID NO: 392 - DNA, 2103 bp, Arabidopsis thaliana
atggtttcaagatcgtattcaaatctgttggagttagcttcaggagactcaccaacgtttggacgcatgaaccgacaaatcccacgaatcatggccgttgctggaatcatgtcaaacatcgataatgactctaaagacactgatctgtctcctaaagatcgtatcatcattgtagccaatgaattacctatacgagctcagagaagggttgatggtaatggtagtggtagtagtagtagtagtacttgttgtagcaaaggttggaacttttcttgggatgagaattcacttcttctccaattgaaagatgggttaggagatgaagctattgaagttatctatgttggttgtttgaaagaagagattcctcttaatgagcaagaagaagtgtatcagattcttcttgagagtttcaagtgtgtgcctacgtttttgcctttggatttgtacactagatactaccatggattctgtaagcaacagctttggcctttgtttcattacatgttgccactttctcctgatcttggaggtaggtttgataggactttgtggcaagcttatgtctctgtgaacaagatttttgctgatagaattatggaggtgattaatcctgaggatgattttgtgtggatacatgattatcatttgatggttttgcctactttcttgaggaagaggtttaacagagtcaagcttggtttcttccttcatagtccatttccatcgtctgagatttacaaaactttgcctattcgtgaagagcttcttcgggctttgctaaactcggatttgatagggttccatacttttgactacgctaggcatttcttgtcttgttgtagtcgaatgcttggtcttacttatgaatctaagagaggatacattggacttgagtattatggtagaaccgtgagtatcaaaattctacctgttggaatccacatgggtcagcttcagtcggttttgagcttacccgagactgaaaggaaagtcggggaacttattgaacggtatggtcgaaaaggcaggacgatgctgcttggtgtggatgatatggacattttcaaagggattactttaaagctgttggctatggagcagctgcttatgcaacatcctgaatggcaagggaaggttgtgttggtgcagatagctaatccggcgagagggaaagggaaagatgttaaagagatgcaagctgagacgtattcaactgttaagcggattaatgaaacgtttgggagacccggttacgatcctatagtattgatcgatgcaccgttgaagttctatgaaagggttgcttattacgtagtagctgagtgttgtttggtgacagcggttagggatgggatgaatcttataccttatgagtacatagtttctcgtcaaggaaatgagaaactggacaaaattctgaagctggaggcgaataatcgtaacaagaaaagcatgctggtggtttctgagtttattggttgctctccatcgctaagcggagccattcgtgttaatccatggaatgttgatgcagtagctgatgcaatggatagtgcccttgaagtagctgaaccggagaagcagctaagacatgagaagcattacaagtatgtgagcacacatgatgttggctattgggctcgtagcttcctccaagatcttgagaggagttgtggtgagcatggacgaaggaggtgttggggaattgggtttggtctcagtttcagagttgtggcactagaccagagcttcaggaagctgtcaatggaacacatagtatcagcttataagaggacaaagacacgggctatccttttagactatgatgatactttaatgccacaaggctcgatcgataaaaggccttcatcgaagtcaatcgacatattgaacaccttgtgtagggacaagggcaatctggtgttcattgttagtgctaaaagccgagaaactctatcggactggtttagtccttgtgagaagcttggtattgctgctgaacatggctattttctgaggtattcaaccaaaactttttattttctagcattacctttatatcttataactcaagctccatctaactactacacaggctaa

SEQ ID NO: 393 - protein, 700 aa, Arabidopsis thaliana
MVSRSYSNLLELASGDSPTFGRMNRQIPRIMAVAGIMSNIDNDSKDTDLSPKDRIIIVANELPIRAQRRVDGNGSGSSSSSTCCSKGWNFSWDENSLLLQLKDGLGDEAIEVIYVGCLKEEIPLNEQEEVYQILLESFKCVPTFLPLDLYTRYYHGFCKQQLWPLFHYMLPLSPDLGGRFDRTLWQAYVSVNKIFADRIMEVINPEDDFVWIHDYHLMVLPTFLRKRFNRVKLGFFLHSPFPSSEIYKTLPIREELLRALLNSDLIGFHTFDYARHFLSCCSRMLGLTYESKRGYIGLEYYGRTVSIKILPVGIHMGQLQSVLSLPETERKVGELIERYGRKGRTMLLGVDDMDIFKGITLKLLAMEQLLMQHPEWQGKVVLVQIANPARGKGKDVKEMQAETYSTVKRINETFGRPGYDPIVLIDAPLKFYERVAYYVVAECCLVTAVRDGMNLIPYEYIVSRQGNEKLDKILKLEANNRNKKSMLVVSEFIGCSPSLSGAIRVNPWNVDAVADAMDSALEVAEPEKQLRHEKHYKYVSTHDVGYWARSFLQDLERSCGEHGRRRCWGIGFGLSFRVVALDQSFRKLSMEHIVSAYKRTKTRAILLDYDDTLMPQGSIDKRPSSKSIDILNTLCRDKGNLVFIVSAKSRETLSDWFSPCEKLGIAAEHGYFLRYSTKTFYFLALPLYLITQAPSNYYTG

SEQ ID NO: 394 - DNA, 2571 bp, Arabidopsis thaliana
atggtgtcaagatcttgtgctaattttctagacttatcatcttgggaccttttagattttcctcaaactccacgaactcttccacgcgtcatgactgttccgggaatcatcaccgacgtagacggtgatacaacctccgaagtaacttctacctccggtggttcacgtgagaggaagatcattgtagctaacatgttaccactccaatctaaaagagatgcagaaactggtaaatggtgttttaactgggacgaagactctctccagttacaacttagagatgggttctcttcagaaacagagtttctctacgttggatcacttaacgtagacatcgaaactaacgaacaagaagaagtttcacagaagcttttagaggaatttaactgcgttgcaacgtttttgtctcaagagttgcaagaaatgttctatcttggtttctgtaaacatcagttatggccactctttcattacatgcttccaatgtttcctgatcatggtgatcgttttgatcgacgtctatggcaagcttatgtatcagccaacaagatattttcagatagagttatggaagttatcaaccctgaggatgattacgtttggattcaagattatcatcttatggttcttcctactttcttgaggaaacgttttaataggatcaaactcggtttcttccttcatagtccgtttccttcttcagagatttaccgcacattgcctgttcgtgacgagattttgagaggtttgttgaattgtgatctcattggtttccatacgtttgattacgcgaggcatttcttgtcttgttgtagtagaatgcttggtcttgattacgagtctaagcgcggtcacataggtcttgattactttggtaggactgtgtatatcaaaatacttcctgttggtgttcatatgggtagattggagtctgttttgagtcttgattctactgcggcgaagacgaaagagattcaagaacagtttaaagggaagaagcttgttcttggtatcgatgatatggatatatttaaagggataagcttaaagcttatagcaatggaacatctctttgagacttattggcatttgaaagggaaagttgttcttgttcagatagtgaaccctgcaagatcttctggtaaagatgttgaagaagcgaagagggagacgtatgagactgcgaggaggatcaatgagcgttacggtacttctgactataagccgatagttttgatcgatcgtcttgttccacgttctgagaaaaccgcgtattatgctgcagcagattgttgcttagtgaatgcagtgagagatggtatgaacttagttccttataagtatatcgtctgcaggcaggggactcgaagtaataaggccgttgtggattcatcgcctcgcacaagcactcttgtcgtgtctgagtttattggatgctcaccttctttgagtggtgccattagggtgaatccatgggatgtggatgctgttgctgaagcggtaaactcggctcttaaaatgagtgagactgagaagcaactacggcatgagaaacattatcattatattagcactcatgatgttggttattgggcaaagagctttatgcaggatcttgagagagcgtgccgagatcattatagtaaacgttgttgggggattggttttggtttggggttcagagttttgtcactctctccaagttttaggaagctatctgtggaacacattgttccagtttatagaaaaacacagagaagagctatatttcttgattatgatggtactcttgttcctgaaagctccattgttcaagatccaagcaacgaggttgtctctgttctgaaagctctctgtgaagatccgaataacacggtgtttattgttagtggaagaggtagagagtctctgagcaattggctatctccttgtgaaaatcttggaatagcagctgaacatggatacttcattagatggaagagcaaagatgagtgggagacttgttattcgcctacggatacagagtggaggtcaatggtggaaccggttatgagatcgtatatggaggcaacagatgggacgagtatagagtttaaagaaagtgctttggtgtggcaccatcaagacgcagatcctgactttggatcatgtcaagctaaggagatgcttgatcatctagagagtgttctcgccaatgagcctgtggttgtcaagagaggtcaacacatcgttgaagtcaaaccacaaggtgtaagcaaaggtctagctgcggagaaagtaatccgagaaatggtagaacgcggggagccaccggaaatggtgatgtgcataggagacgatagatcagacgaagacatgtttgagagcatattaagcacagtgacaaatccggaacttcttgtgcagccagaggtttttgcatgcacggttggaagaaaaccaagcaaagctaaatacttcttggacgatgaagccgacgtgcttaagctcctaagaggtcttggagactcatcatcgagcttaaaacctagttcttctcacacacaagttgcatttgaaagcatcgtttaa

SEQ ID NO: 395 - protein, 856 aa, Arabidopsis thaliana
MVSRSCANFLDLSSWDLLDFPQTPRTLPRVMTVPGIITDVDGDTTSEVTSTSGGSRERKIIVANMLPLQSKRDAETGKWCFNWDEDSLQLQLRDGFSSETEFLYVGSLNVDIETNEQEEVSQKLLEEFNCVATFLSQELQEMFYLGFCKHQLWPLFHYMLPMFPDHGDRFDRRLWQAYVSANKIFSDRVMEVINPEDDYVWIQDYHLMVLPTFLRKRFNRIKLGFFLHSPFPSSEIYRTLPVRDEILRGLLNCDLIGFHTFDYARHFLSCCSRMLGLDYESKRGHIGLDYFGRTVYIKILPVGVHMGRLESVLSLDSTAAKTKEIQEQFKGKKLVLGIDDMDIFKGISLKLIAMEHLFETYWHLKGKVVLVQIVNPARSSGKDVEEAKRETYETARRINERYGTSDYKPIVLIDRLVPRSEKTAYYAAADCCLVNAVRDGMNLVPYKYIVCRQGTRSNKAVVDSSPRTSTLVVSEFIGCSPSLSGAIRVNPWDVDAVAEAVNSALKMSETEKQLRHEKHYHYISTHDVGYWAKSFMQDLERACRDHYSKRCWGIGFGLGFRVLSLSPSFRKLSVEHIVPVYRKTQRRAIFLDYDGTLVPESSIVQDPSNEVVSVLKALCEDPNNTVFIVSGRGRESLSNWLSPCENLGIAAEHGYFIRWKSKDEWETCYSPTDTEWRSMVEPVMRSYMEATDGTSIEFKESALVWHHQDADPDFGSCQAKEMLDHLESVLANEPVVVKRGQHIVEVKPQGVSKGLAAEKVIREMVERGEPPEMVMCIGDDRSDEDMFESILSTVTNPELLVQPEVFACTVGRKPSKAKYFLDDEADVLKLLRGLGDSSSSLKPSSSHTQVAFESIV

SEQ ID NO: 396 - DNA, 2589 bp, Arabidopsis thaliana
atgtcgccggaatcttggaaagaccagcttagtctggtttcggctgatgattatcggatcatgggtcgaaatcggatccccaatgccgtcacgaagctttccggtctcgaaaccgacgatcctaacggcggcgcgtgggttacgaaaccgaaacgaatcgtggtttcgaatcagcttcctcttcgtgctcacagagacatttcgtcgaacaagtggtgctttgaattcgacaatgacagtctttacttacaactcaaagatgggtttcctccggagacggaagtcgtctacgtcggatctttaaacgccgacgtcttaccttcagagcaagaggacgtctctcagttcttgcttgagaagtttcagtgtgttcctactttcttacctagtgacttgctcaacaagtattaccatggtttctgtaaacactatctctggcccatttttcactatcttcttcctatgacgcaagctcaaggctctctctttgatcgttcgaattggagagcgtacacgactgttaacaagatcttcgctgataagatcttcgaagtgctaaacccggatgatgattacgtctggattcatgattatcacctcatgattttgcccacttttttgaggaacaggtttcatcggataaagcttgggattttcctccatagtccctttccttcgtcggagatttaccgtactcttcctgtgagagacgagattctcaaagggtttctgaattgcgatttggttggtttccacacgtttgattacgctaggcatttcttgtcttgttgtagtaggatgcttggtcttgattacgaatctaaaagaggctacattggtcttgaatattttggaagaacggtgagcatcaagatattgcccgttgggattcatatggggcagattgaatcgataaaggcttcggagaaaactgcagagaaagtgaagagattgagagaaaggttcaaggggaacattgtgatgttaggtgtggatgatttggatatgttcaaaggtattagcttgaagttttgggcgatgggtcagcttcttgaacagaacgaagagcttcgtgggaaagtggttctcgtgcagattactaatcctgctcgtagttcaggtaaggatgttcaagatgtagagaaacagataaatttgattgctgatgagatcaattctaaatttgggagacctggtggttataagcctattgtgtttatcaatggacctgttagtactttggataaagttgcttattacgcgatctcggagtgtgttgtcgtgaatgctgtgagagatgggatgaatttggtgccttataagtacacagtgactcggcaagggagccctgctttggatgcagctttaggttttggggaggatgatgttaggaagagtgtgattattgtttctgagttcatcggttgttctccatctctgagtggtgcgatccgtgttaatccgtggaacatcgatgcagtcactaacgccatgagctctgcaatgacgatgtccgacaaagagaaaaatctgcgccaccagaagcatcataagtacataagctctcacaatgttgcctattgggcgcggagttatgaccaagatcttcaaagggcgtgcaaagatcattacaacaagagattctggggagtcggattcggtctttttttcaaggttgttgcgttagatccgaatttcagaaggctctgtggtgaaaccatagtccccgcgtataggagatcaagcagtaggttgatcctattggactatgatgggacaatgatggatcaggatactctggataaaaggccaagtgatgatcttatctcgcttctcaatcgcttatgtgacgaccccagcaatctagtctttattgttagtggtcgaggtaaggaccctctcagcaaatggtttgactcttgcccaaatcttggtatctcagctgaacatggttatttcactagatggaactcaaattccccttgggaaacaagtgaattgcctgcggatttaagctggaagaaaatagctaaaccagtgatgaatcactatatggaagcgactgatggatcattcatagaggagaaagagagtgctatggtgtggcaccaccaagaagctgaccattcatttggttcttggcaagctaaggagcttcttgatcatctagagagtgttctcaccaatgagcctgttgttgtcaagagaggccagcacatagtagaagttaaacctcagggagtaagcaaaggaaaggtggtggagcatttgatagcaacgatgaggaacaccaaagggaagagaccggactttttgttgtgcataggtgatgaccggtctgatgaagacatgtttgatagcatagtgaagcaccaagatgtttcctctattggtctcgaagaggtctttgcgtgcacagttggtcagaaaccgagcaaggccaagtactatctcgatgataccccaagtgttatcaagatgcttgaatggttggcctcagcttcagatggatcaaagcatgagcaacagaagaaacagagcaagttcacttttcaacagcctatgggacaatgtcgaaagaaagcatag

SEQ ID NO: 397 - protein, 862 aa, Arabidopsis thaliana
MSPESWKDQLSLVSADDYRIMGRNRIPNAVTKLSGLETDDPNGGAWVTKPKRIVVSNQLPLRAHRDISSNKWCFEFDNDSLYLQLKDGFPPETEVVYVGSLNADVLPSEQEDVSQFLLEKFQCVPTFLPSDLLNKYYHGFCKHYLWPIFHYLLPMTQAQGSLFDRSNWRAYTTVNKIFADKIFEVLNPDDDYVWIHDYHLMILPTFLRNRFHRIKLGIFLHSPFPSSEIYRTLPVRDEILKGFLNCDLVGFHTFDYARHFLSCCSRMLGLDYESKRGYIGLEYFGRTVSIKILPVGIHMGQIESIKASEKTAEKVKRLRERFKGNIVMLGVDDLDMFKGISLKFWAMGQLLEQNEELRGKVVLVQITNPARSSGKDVQDVEKQINLIADEINSKFGRPGGYKPIVFINGPVSTLDKVAYYAISECVVVNAVRDGMNLVPYKYTVTRQGSPALDAALGFGEDDVRKSVIIVSEFIGCSPSLSGAIRVNPWNIDAVTNAMSSAMTMSDKEKNLRHQKHHKYISSHNVAYWARSYDQDLQRACKDHYNKRFWGVGFGLFFKVVALDPNFRRLCGETIVPAYRRSSSRLILLDYDGTMMDQDTLDKRPSDDLISLLNRLCDDPSNLVFIVSGRGKDPLSKWFDSCPNLGISAEHGYFTRWNSNSPWETSELPADLSWKKIAKPVMNHYMEATDGSFIEEKESAMVWHHQEADHSFGSWQAKELLDHLESVLTNEPVVVKRGQHIVEVKPQGVSKGKVVEHLIATMRNTKGKRPDFLLCIGDDRSDEDMFDSIVKHQDVSSIGLEEVFACTVGQKPSKAKYYLDDTPSVIKMLEWLASASDGSKHEQQKKQSKFTFQQPMGQCRKKA

SEQ ID NO: 398 - DNA, 2589 bp, Arabidopsis thaliana
atggtatcaagatcttattcaaacctcttggatcttgcttctggtaacttccattcgttttctcgagaaaagaagaggtttccaagagtagcaactgtcactggtgtcttatctgagctagatgatgataacaacagcaacagtgtctgctctgatgctccttcttccgtcacacaagatcgaatcatcatcgttggaaaccagcttcctattaaatcacatcggaactctgctggtaaattgagttttagttgggacaatgactcgcttctcttgcagcttaaagatggtatgcgtgaagatatggaagttgtctacattggttgccttaaggaacagattgatacagttgagcaagatgatgtttctcaaaggttgcttgagaatttcaaatgtgttcctgcttatatcccacctgagctattcactaagtactatcatggattctgtaagcaacatctatggcctttgtttcactacatgcttcccttaactcctgatcttggtggtagatttgatcgttctttatggcaagcttatctttcggttaacaagatctttgctgataaagtgatggaagtgattagtcctgatgatgattttgtttgggttcatgactatcacttaatggttttgcctacatttctaaggaagaggtttaatagagtaaagcttggttttttccttcatagcccgttcccttcctctgagatttaccgtactcttccagtgagaaatgagctcttacgtgcactcctcaacgctgatttgattggctttcatacctttgactatgcaagacacttcctttcttgttgtagcaggatgcttggtttatcctatcagtccaaacgtggaaccatagggcttgagtattatggtcgaacggttagtatcaagattcttcctgtggggattcatatcagccagcttcagtcaattttaaacctcccagagactcagaccaaagttgctgagctaagagatcagttcttggatcagaaagttcttctcggtgttgatgacatggacatcttcaaaggaatcagcctcaaactcttggcaatggaacaacttctcacacagcatcccgagaagagaggtcgagttgtacttgtccagattgcaaaccctgcaagaggtcgtgggaaagacgttcaggaggttcagtctgaaactgaagccacggttaaaaggatcaatgaaatgtttggaaggccgggctaccaacccgtggttctgattgatacaccgcttcaattctttgagaggattgcttactatgtcattgcagagtgttgtcttgttacagcggtaagagatggtatgaatcttataccttatgagtacattatctgcaggcaaggtaatccgaaactcaacgagactataggccttgacccttctgctgcaaagaagagtatgcttgttgtctctgagtttattggttgttctccttctttaagcggcgccattagagtaaatccgtggaacattgatgctgtgactgaagcaatggactatgcattgatagtttcagaagcagagaagcaaatgcgtcacgagaagcatcacaaatatgttagcacacatgatgttgcttattgggcgcgtagctttatacaagatcttgaaagggcttgcggggatcatgtgaggaagaggtgttgggggattggattcgggttaggctttagagttgtggcgcttgatccgagttttaaaaagctttcgattgagcacattgtctcagcttataagagaaccaagaaccgagccattttgttggattatgatggcacaatggtgcagccaggttccattaggacaacaccaacccgcgaaacaatcgaaatcttgaacaacctgtctagtgatcccaagaatatcgtgtacctcgtcagtgggaaagacagaaggacactaactgaatggttttcttcatgtgacgatctcggtttgggtgcagagcacgggtattttataaggccaaatgatggaacagactgggaaacgtcgagtttggtatcaggttttgagtggaaacaaatagcagagccagtgatgagactttacactgagactacagatggatcaacaatagagactaaagagactgctctcgtttggaattaccaattcgcagatcctgattttggatcttgtcaagccaaagagcttatggaacacctcgaaagcgtgcttaccaatgatccagtctctgtcaagactggacaacaactcgttgaagttaaaccacagggtgtgaacaaaggtcttgtggcagagaggcttctaacaacgatgcaagaaaaagggaaacttttggatttcattctctgcgtcggtgatgatcggtctgatgaggatatgtttgaggtgataatgagtgctaaagatggtccagctttgtctcctgtggctgagatattcgcttgcaccgttggacaaaagccaagcaaagcaaaatactatttagacgatactgcggagataatcagaatgctggacggtctagccgctaccaacacaactatctctgatcaaactgattcaaccgccactgttccaactaaagatctgttttaa

SEQ ID NO: 399 - protein, 862 aa, Arabidopsis thaliana
MVSRSYSNLLDLASGNFHSFSREKKRFPRVATVTGVLSELDDDNNSNSVCSDAPSSVTQDRIIIVGNQLPIKSHRNSAGKLSFSWDNDSLLLQLKDGMREDMEVVYIGCLKEQIDTVEQDDVSQRLLENFKCVPAYIPPELFTKYYHGFCKQHLWPLFHYMLPLTPDLGGRFDRSLWQAYLSVNKIFADKVMEVISPDDDFVWVHDYHLMVLPTFLRKRFNRVKLGFFLHSPFPSSEIYRTLPVRNELLRALLNADLIGFHTFDYARHFLSCCSRMLGLSYQSKRGTIGLEYYGRTVSIKILPVGIHISQLQSILNLPETQTKVAELRDQFLDQKVLLGVDDMDIFKGISLKLLAMEQLLTQHPEKRGRVVLVQIANPARGRGKDVQEVQSETEATVKRINEMFGRPGYQPVVLIDTPLQFFERIAYYVIAECCLVTAVRDGMNLIPYEYIICRQGNPKLNETIGLDPSAAKKSMLVVSEFIGCSPSLSGAIRVNPWNIDAVTEAMDYALIVSEAEKQMRHEKHHKYVSTHDVAYWARSFIQDLERACGDHVRKRCWGIGFGLGFRVVALDPSFKKLSIEHIVSAYKRTKNRAILLDYDGTMVQPGSIRTTPTRETIEILNNLSSDPKNIVYLVSGKDRRTLTEWFSSCDDLGLGAEHGYFIRPNDGTDWETSSLVSGFEWKQIAEPVMRLYTETTDGSTIETKETALVWNYQFADPDFGSCQAKELMEHLESVLTNDPVSVKTGQQLVEVKPQGVNKGLVAERLLTTMQEKGKLLDFILCVGDDRSDEDMFEVIMSAKDGPALSPVAEIFACTVGQKPSKAKYYLDDTAEIIRMLDGLAATNTTISDQTDSTATVPTKDLF

SEQ ID NO: 400 - DNA, 2607 bp, Ginkgo biloba
atgatgtcaagatcttatacaaatcttatggatctggccacggggaatttcccggcctttggacgagctaccaagcggcttcctagagtcatgactgtgcctgggatcatctctgagctcgacgatgacaatagcaatagtgtgtcatcagatgtgccttcttccatctgccaggagcgcatgatcattgtagctaaccagcttcctttgcgggcacagaggaggccagataatagaggctgggcttttagttgggacgaggattctttgcttttgcagctcaaggatggcttagcagaggatatggaagtagtctatgttggtagcttgaaggtggaagttgaccttagcgaacaagatgatgttgcacagattctacttgaaaatttcaagtgcgtgccagcttttctccctccggaacttttgaccaaattttaccatggattctgcaagcagcagctctggccactattccattatatgttacctctttctccagatcacggaggtcgctttgatcggtctctctggcaggcttatgtatctgcaaataagatttttgcagacaaggtaatggaggtgatcagccctgatgatgactatgtctgggtgcacgattaccatctcatggtcctgcctacgtttcttaggaagcgatctaacagggtgaagcttggttttttcctgcacagccccttcccttcatcggaaatctaccgaactcttcctgttagagatgagattcttagggccctcctgaactcagatttgattggtttccataccttcgactatgcgaggcattttctatcctgctgcagcaggatgctgggtcttgagtatgaatctaagagagggtacattgggttggaatactatggccggactgtgggcattaagatcctccctgtgggcatacacatgggtcagcttgaatctgtgttgaatcttgctgacacagagtggagagtcggagaactgagggaccagttcaaggggaaaattcttcttcttggtgtcgatgacatggatatcttcaaaggcatcagcttgaagtttctggcaatggagcagctacttaagctgcatccagagtggagaggcaaggtagtgttagtgcagattgctaatcctgcaaggggtaggggcaaagatgtggaggatgtgcaagctgagacacattctacggccaagagaataaatgaaacctttgggcgcccgggctatgaacctgtggtgttgatagacagacctgttcctttctatgagagaatagccttctacaccattgcagaatgttacgtaataactgctgtgagggatgggatgaatctcactccctatgaatacattgtttgcaggcaggggagtccaagattgaatgaaaccttgggagtgagtccgaatgtttcgaagaagagcatgctggttgtgtctgagtttattggatgctcaccttctctcagcggggctatcagggtcaatccttggaacattgatgctgtagctgaggccatgagcacagccattacaatgcctgagacggaaaaacaactaagacatgaaaaacattacaggtatgttagtacccatgatgtggggtattgggcacacagttttatgcaagatctagagagagcgtgcaaggatcacttccgtaggaggtgctggggtattgggtttgggttgggattcagggtagtagcacttgatccaaacttcagaaagctttcaacagagcacattgtctctgcatacaagaggaccaagagtagggcaatattgttggactatgatggtacaatgatgcctcagacttctatcaacaaaactcctgggtcggaggtgctttttattttgaacagcttgtgcagtgatccaaagaatgttgttttcattgttagtggaaggggaaggcagactcttagtcaatggttgtctccttgcgaaatgttggggattgcagcagagcatggctattttataaggtggactcgagatgcagaatgggaaacttgtgttcagggtgtagattttggttggaaacaaataacggagcctgtcatgaaattatatactgagactacggatggctctgtaattgaaacaaaagagagcgctttggtttggcatcatcaagatgctgatccggactttggttcctgtcaggcaaaggagcttctagatcatttggagagtgtacttgcaaatgagcctgtggttgtcaaaagtggtcaacatattgtagaggtgaaacctcagggtgtgagcaagggcctagtagcagagcgacttctttcaataatggtgcaaaatgacaagcgaccagactttgtcatgtgcattggagatgacagatcagatgaagacatgtttgaggggataacaagtgctatggcaggaccttcactttctccaatagcagaagtatttgcatgtactgttggtcagaagcccagcaaagcaaagtactatcttgatgatactgtagaagttctaagaatgcttcagggtctggcggctgcctctgatcaaacagcaaagacttcatctgatcaagcagcaaagaatccatctgctcaagtagctcttgagtgctcactttga

SEQ ID NO: 401 - protein, 868 aa, Ginkgo biloba
MMSRSYTNLMDLATGNFPAFGRATKRLPRVMTVPGIISELDDDNSNSVSSDVPSSICQERMIIVANQLPLRAQRRPDNRGWAFSWDEDSLLLQLKDGLAEDMEVVYVGSLKVEVDLSEQDDVAQILLENFKCVPAFLPPELLTKFYHGFCKQQLWPLFHYMLPLSPDHGGRFDRSLWQAYVSANKIFADKVMEVISPDDDYVWVHDYHLMVLPTFLRKRSNRVKLGFFLHSPFPSSEIYRTLPVRDEILRALLNSDLIGFHTFDYARHFLSCCSRMLGLEYESKRGYIGLEYYGRTVGIKILPVGIHMGQLESVLNLADTEWRVGELRDQFKGKILLLGVDDMDIFKGISLKFLAMEQLLKLHPEWRGKVVLVQIANPARGRGKDVEDVQAETHSTAKRINETFGRPGYEPVVLIDRPVPFYERIAFYTIAECYVITAVRDGMNLTPYEYIVCRQGSPRLNETLGVSPNVSKKSMLVVSEFIGCSPSLSGAIRVNPWNIDAVAEAMSTAITMPETEKQLRHEKHYRYVSTHDVGYWAHSFMQDLERACKDHFRRRCWGIGFGLGFRVVALDPNFRKLSTEHIVSAYKRTKSRAILLDYDGTMMPQTSINKTPGSEVLFILNSLCSDPKNVVFIVSGRGRQTLSQWLSPCEMLGIAAEHGYFIRWTRDAEWETCVQGVDFGWKQITEPVMKLYTETTDGSVIETKESALVWHHQDADPDFGSCQAKELLDHLESVLANEPVVVKSGQHIVEVKPQGVSKGLVAERLLSIMVQNDKRPDFVMCIGDDRSDEDMFEGITSAMAGPSLSPIAEVFACTVGQKPSKAKYYLDDTVEVLRMLQGLAAASDQTAKTSSDQAAKNPSAQVALECSL

SEQ ID NO: 402 - DNA, 2586 bp, Gossypium hirsutum
atggcatcaagatcatgtgcaaattttttacacttagcctctgggaatctacttgatattcctcaaactccgagaggtcttcctcgggtaatgactgttcctgggattatctctgacatggactcttgtagcagtaatgatggggattcagatgttgcttcatctgggtgtagagaacgcaaaattatagtggcaaatatgttacctttgcatgctaaaagagatcgtgaaacttcgaaatggcgcttcagctgggatgaggattcacttttactacatctaaaggatgagttttctcctgaaatggaggttgtatacgtaggatctctcaaggttgatatagatgtgaatgaacaggaagaagttgcccaaaagctgttagaagatttcaattgcgtccctacatttgtacctcatgatttgcagaagaagttttatcttggcttctgcaaacagcatttgtggcctctttttcactacatgctgcccatgtgtcctgaccatggtgatcggtttgaccgcattttatggcaggcatatgtttctgctaataaaatatttgctgacaaggttatggaagtaatcaatccagatgatgattatgtctggattcatgattatcatttgatggttcttcccacatttttgaggaagcacctgaatagaatcaagcttggttttttcctccacagcccgtacccttcatcagaaatatatcgaacattgcctgttcgggatgaaattctgaggggactactgaattgcgatctaattggttttcatacgttcgattatgcacgacatttcttatcttgctgcagtagaatgctgggtcttgattatgaatctaaaagagggcatattggtcttgattactttggtcgcacggtttttattaagattctacctgtaggagttcatatgggtagacttgaatcagtcttgaatctttcctctactgctgccagggtcaaagagattcagaaacagtttgaagggaaaaaattgattcttggcatagatgatatggatattttcaaaggcatcagtcttaaattactggctgtggaacagctcttacagcagcacccagacctgcagggtaaaatagtcctggttcagattgtgaatcctgcaaggggctttggaaaggatgtccaggaggctaagaaggagacttatatgactgctaaaaagatcaatgaggtttatggttcccccaattatcagccagtgattttgattgatcgccctgttccccgttatgagaaatcggcctattatgcgctagcagaatgttgcatagtaaatgctgtgagggatgggatgaacctggttccttacaagtatattgcttgtcggcagggaactcctggcatggatgaggcactgggtgtaaagccagaatatccacgaacaagcatgcttgttgtttctgagctcatcggttgctcaccgtctttaagtggagcaattagggtaaatccatgggatatcgatgctgtggctgaggctttaaatacagctattaccaagcccgagtcagagaagcaattgcgacatgagaaacactaccggtatgtcagtactcatgatgtggcatattgggctcgcagctttgtgatggacttggatagagcatgccaggatcactatagtaaacgttgctggggcattggtttgggcctcagtttcagagttgtgtctctttcacctagttttaggaggctagctatcgatcacatttgttcggcatatagacgaacaaatagaagagcaatattcctggactatgatggcactcttgttcctgaagcttccattatcaaaactcctagccctgaggttatctgtatcattaagaccctctgtgatgatcctaagaacacagtgtttattgttagtgggagaggaagagcttcgcttagtgattggcttgctccatgtgagaagctggggatagccgctgaacacgggtacttcataagatggagtaaagactctgaatgggaaaccagccctgttggtgctgaccttgaatggaaaaagattgtggaacctgttatgagcttgtatagagaggcaactgatggctccagcatagagaccaaggagggtggtttggtgtggcaccatctagatgcagaccctgacttcggatcatgccaagccaaggaattgttggatcatttggaaagtgttctcgcaaatgaaccagcggttgtccatagaggccagcatattgttgaagttaagccgcagggagtaagcaaagggctagtagcagaaaaagttttgtcgagaatggtcaatggtgggaagccacctgatttcgtgatgtgtgttggtgatgataaatccgatgaagatatgtttcagagcatattaacttcagtttctaatccatccttgcctgtggctccggaaatctttgcatgcacagtggggcgaaagcctagcaaagctaggtattacctcgatgacactgcagatgttttaaagttacttaaaggccttgcaactgctacaatttcaaagcctaggtgcctgcctgagattaaggtatctttcgagagtaatgcttga

SEQ ID NO: 403 - protein, 861 aa, Gossypium hirsutum
MASRSCANFLHLASGNLLDIPQTPRGLPRVMTVPGIISDMDSCSSNDGDSDVASSGCRERKIIVANMLPLHAKRDRETSKWRFSWDEDSLLLHLKDEFSPEMEVVYVGSLKVDIDVNEQEEVAQKLLEDFNCVPTFVPHDLQKKFYLGFCKQHLWPLFHYMLPMCPDHGDRFDRILWQAYVSANKIFADKVMEVINPDDDYVWIHDYHLMVLPTFLRKHLNRIKLGFFLHSPYPSSEIYRTLPVRDEILRGLLNCDLIGFHTFDYARHFLSCCSRMLGLDYESKRGHIGLDYFGRTVFIKILPVGVHMGRLESVLNLSSTAARVKEIQKQFEGKKLILGIDDMDIFKGISLKLLAVEQLLQQHPDLQGKIVLVQIVNPARGFGKDVQEAKKETYMTAKKINEVYGSPNYQPVILIDRPVPRYEKSAYYALAECCIVNAVRDGMNLVPYKYIACRQGTPGMDEALGVKPEYPRTSMLVVSELIGCSPSLSGAIRVNPWDIDAVAEALNTAITKPESEKQLRHEKHYRYVSTHDVAYWARSFVMDLDRACQDHYSKRCWGIGLGLSFRVVSLSPSFRRLAIDHICSAYRRTNRRAIFLDYDGTLVPEASIIKTPSPEVICIIKTLCDDPKNTVFIVSGRGRASLSDWLAPCEKLGIAAEHGYFIRWSKDSEWETSPVGADLEWKKIVEPVMSLYREATDGSSIETKEGGLVWHHLDADPDFGSCQAKELLDHLESVLANEPAVVHRGQHIVEVKPQGVSKGLVAEKVLSRMVNGGKPPDFVMCVGDDKSDEDMFQSILTSVSNPSLPVAPEIFACTVGRKPSKARYYLDDTADVLKLLKGLATATISKPRCLPEIKVSFESNA

SEQ ID NO: 404 - DNA, 2637 bp, Oryza sativa
atgttctcgcgatcctacaccaacctggtcgatctcgccaacggcaacctctccgccctggactatggtggcggagggggagggggcggcggcggcaacggggccgggggccggccgccgcgggcgaggcggatgcagcggacgatgacgacgcccgggacgctggcggagctcgacgaggagcgggccgggagcgtcacctccgacgtgccctcgtcgctcgccagcgaccgcctcatcgtcgtcgccaacaccctccccgtgcgctgcgagcgccgccccgacgggcgcgggtggagcttctgctgggacgaggactccctcctcctccacctccgcgacggcctccccgatgacatggaggtcctctacgtcggctccctccgcgccgacgtgccgtccgccgagcaggacgacgtcgcgcaggcgctcctcgaccggttccgctgcgtcccggctttcctccccaaggacgtcttggacagattctaccatggcttctgcaagcagacgctgtggccgctcttccactacatgctccccttcacctccgaccatggcggccgcttcgatcgctcccagtgggaggcatacgtcctcgccaacaagctcttctcccagcgcgtcatcgaggtcctcaaccccgaggatgactacatctggatccacgattaccacctcctcgccctcccgtccttccttcgccgtcggttcaacaggctccgcatcggtttcttcctgcacagcccgttcccttcgtcggaactctaccgttccctccctgttcgcgacgagatcctcaaatcactgctaaactgcgatctgattgggttccacacctttgattacgcgcggcatttcctgtcctgctgcagccggatgctggggatcgagtaccagtcgaagaggggatatatcggtctcgattactttggccgcactgttgggataaagatcatgcctgttgggattaacatgacgcagctgcagacgcagatccggctgcctgatcttgagtggcgtgtcgccgaactccggaagcagtttgatgggaagactgtcatgctcggtgtggatgatatggacatatttaaggggattaatctgaaagttcttgcgtttgagcagatgctgaggacacacccaaaatggcagcgcaaggcagtgttggtgcagattgcaaacccaaggggtggtggtgggaaggaccttgaagagatacaggctgagattgatgagagttgcaggaggataaatgcacaattttcacggccaggatatgttcctgtggtgattatcaatagagccctttcaagtgtggagaggatggcttattataccgtggcagagtgtgtcgttgtaactgcagtgagggatgggatgaacctcacaccatatgagtatattgtctgtagacagggatttccagatttggatggttctggggatgatgggccaaggagaaagagtatgttagttgtgtccgaattcattggttgctcaccatcacttagtggagcaattcgggtaaacccttggaacattgatacaacagcagaggcaatgaacgagtcgattgctttatcagagaacgagaagcaactgcggcatgagaagcattacagatatgtcagctcacatgatgttgcctattggtccaagagctatattcatgatttggagagaagctgcagggaccattttaggaggaggtgctggggtattggactaggatttggatttagagtagttgctcttgaccgcaacttcaaaaagcttactgtggattctatcgttactgattacaagaattctaagagcagggttatactgctagactacgatggaacgctagtaccacaaactacaatcaacaggactccaaatgaaagtgttgttaaaatcatgaatgctctttgtgacgataagaagaatgttgtttttattgttagtggacgaggaagggatagccttgagaaatggttttccccttgccaggatcttggcattgctgccgaacatggctactttatgaggtggaccagagatgagcaatggcaattgaataaccagtgctcagaatttggatggatgcagatggccaagccagttatgaacctgtatacagaagcaaccgatggatcatatattgaaaccaaagagagtgctttggtctggcaccaccaagatgctgaccctggttttggatcttcacaagctaaagagatgctagatcatttggaaagtgttcttgctaatgagcctgtctgtgtaaagagtggccaacagattgtggaagtgaaaccgcagggtgtcagcaaaggatttgttgctgagaagatcctatcaacgctgacagagaacaagagacaggcagattttgttctctgcataggcgatgatagatcagacgaggatatgtttgaaggaattgctgatatcatgagaaggagcatagttgatccccaaacatcattatatgcgtgcacagtcggccagaagccaagcaaggctaagtactatttggacgatactaatgatgttttgaacatgcttgaggcgcttgcagatgcatcagaggagactgattcacaggaagatgcagaagagataacatctatcccggacccggaatag

SEQ ID NO: 405 - protein, 878 aa, Oryza sativa
MFSRSYTNLVDLANGNLSALDYGGGGGGGGGGNGAGGRPPRARRMQRTMTTPGTLAELDEERAGSVTSDVPSSLASDRLIVVANTLPVRCERRPDGRGWSFCWDEDSLLLHLRDGLPDDMEVLYVGSLRADVPSAEQDDVAQALLDRFRCVPAFLPKDVLDRFYHGFCKQTLWPLFHYMLPFTSDHGGRFDRSQWEAYVLANKLFSQRVIEVLNPEDDYIWIHDYHLLALPSFLRRRFNRLRIGFFLHSPFPSSELYRSLPVRDEILKSLLNCDLIGFHTFDYARHFLSCCSRMLGIEYQSKRGYIGLDYFGRTVGIKIMPVGINMTQLQTQIRLPDLEWRVAELRKQFDGKTVMLGVDDMDIFKGINLKVLAFEQMLRTHPKWQRKAVLVQIANPRGGGGKDLEEIQAEIDESCRRINAQFSRPGYVPVVIINRALSSVERMAYYTVAECVVVTAVRDGMNLTPYEYIVCRQGFPDLDGSGDDGPRRKSMLVVSEFIGCSPSLSGAIRVNPWNIDTTAEAMNESIALSENEKQLRHEKHYRYVSSHDVAYWSKSYIHDLERSCRDHFRRRCWGIGLGFGFRVVALDRNFKKLTVDSIVTDYKNSKSRVILLDYDGTLVPQTTINRTPNESVVKIMNALCDDKKNVVFIVSGRGRDSLEKWFSPCQDLGIAAEHGYFMRWTRDEQWQLNNQCSEFGWMQMAKPVMNLYTEATDGSYIETKESALVWHHQDADPGFGSSQAKEMLDHLESVLANEPVCVKSGQQIVEVKPQGVSKGFVAEKILSTLTENKRQADFVLCIGDDRSDEDMFEGIADIMRRSIVDPQTSLYACTVGQKPSKAKYYLDDTNDVLNMLEALADASEETDSQEDAEEITSIPDPE

SEQ ID NO: 406 - DNA, 2742 bp, Oryza sativa
atgatgtcgcggtcgtacaccaaccttctcgatctcgcggaggggaacttcgcggcgttgggcccgggaggcggcggcggcgggaggcggaggtcggggtcgttcgggctgaagcggatgtcgcgggtgatgacggtgcccgggacgctgtcggagctggacggggaggacgactcggagcacgcggcgacgaacagcgtcgcctccgacgtgccctcgtcggtggcgggggatcgagtcatagtggtctccaaccagctgcccgtcgtcgcacgccgccgtcccgacggccgcgggtggtccttctcatgggacgacgactcgctgctcctccagctccgcgacggcattcccgatgagatggaggtgttcttcgtcggttccctccgcgccgaaatccccgtcgccgaccaggaagaggtctcccaggcgctgctcgatcgcttccgatgtgctccggtgttcctccccgaccccctcaacgaacggttttaccaccgcttctgcaagcgccacctatggcctctgttccactacatgctccctttctcctcctccgcatccccgagtccctcctcctcctcctcctcctcctcctccccctcatcctcatccggcagtggccacttcgaccgcggcgcgtgggaggcctacgtgctcgcgaacaagttcttcttcgagaaggtcgtggaggtcatcaacccagaagacgactacgtatgggttcacgactaccatctcatggcgctgcccaccttccttcgccgccgcttcaaccgcctgcgcatcggcttcttcctccacagccccttcccctcgtcggagatctaccggaccctccctgttcgcgaggagatcctaaaggcgctgctcaattgtgaccttattggattccacacttttgactatgccagacatttcctctcttgttgtagtaggatgctgggaattgaataccagtcaaagcgtggatacattgggttggattactttgggcgtaccgttgggatcaaaatcatgccagtgggagttcatatgggtcaattgaagacggttctgagcttgcccgacagggaatggagggtctccgagctgcagcagcaatttgaggggaagactgtgttgctcggtgtggatgacatggatatcttcaagggtatcaacttgaagcttcttgccttcgagaatatgttgaggacacatcccaagtggcaggggcgggcagtgttggtgcaaattgctaatccggcccgtggaaagggtaaggatcttgaagccatccaggctgagattcatgagagctgcaagaggattaatggagagtttggccagtcaggatacagccctgttgtcttcattgaccgtgatgtgtcaagtgtggagaagattgcctactacacaatagcagaatgtgtggtggtgactgctgtgagggatgggatgaacttgacaccatatgaatatattgtctgtaggcaggggtctgactccacatcagaagtgaatggaccaaagaagagcatgctggtggtatcagaattcattgggtgctcaccatctctgagtggtgctatccgggttaacccatggaatatagaggcaaccgcagaggcactgaatgaggccatatcaatgtcggaacaggagaaacacctaaggcatgagaaacattaccgttatgtcagcacccacgatgttgcttattggtcgaaaagtttcatccaagatttggagagggcttgcaaggaccacttcaggaggacatgttggggcatcgggttggggtttggttttagggtggtggccttagatccccatttcacaaagcttaacatggattcaattgttatggcttatgagcggtcagagagtagggctatatttcttgattatgatggaacactggtgccacagacttccatcagtaggacacctagtgcggaagttttgaggatcatcaataccctgtgctcagataggaggaacaaagtttttcttgtcagtgggagacgcagggacaaattgggagaatggttttcctcttgtccagatctgggcattgcagcagagcatggttacttcttaaggtggactagagacgaagagtggcaaacatgtacccagacctctgacttcgggtggatggaaatggccaagccagtgatgaatctgtatacagaagcaactgatggatcttacattgatcctaaggaaagtgctttggtgtggcatcaccaggatgctgacccaggatttggatcctcccaggcaaaggagttacttgatcatctggaaagtgtattagcaaatgaacctgtttctgtcaaaagtggccagttcattgttgaagtcaaacctcagggagtaagcaagggagtagtagctgagaagatactcgtctcaatgaaggagagaggaaagcaggctgactttgtattatgcattggtgatgacaggtcggatgaggacatgtttgaaaacattgctgataccattaaaaagggtatggttgctacaaacacatcattgtttgcatgcactgtgggacaaaaaccaagcaaggccaaattttacctggatgatacgtttgaagtggtcaccatgctgagcgcactggcagatgctactgaaccagaacctgagactgatcttaccgatgagtttgatgaactggccgtgtctgtctcctcagttgatattgatgatgaacaaacgcccagtgataaactgatcggaggatag

SEQ ID NO: 407 - protein, 913 aa, Oryza sativa
MMSRSYTNLLDLAEGNFAALGPGGGGGGRRRSGSFGLKRMSRVMTVPGTLSELDGEDDSEHAATNSVASDVPSSVAGDRVIVVSNQLPVVARRRPDGRGWSFSWDDDSLLLQLRDGIPDEMEVFFVGSLRAEIPVADQEEVSQALLDRFRCAPVFLPDPLNERFYHRFCKRHLWPLFHYMLPFSSSASPSPSSSSSSSSSPSSSSGSGHFDRGAWEAYVLANKFFFEKVVEVINPEDDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGVHMGQLKTVLSLPDREWRVSELQQQFEGKTVLLGVDDMDIFKGINLKLLAFENMLRTHPKWQGRAVLVQIANPARGKGKDLEAIQAEIHESCKRINGEFGQSGYSPVVFIDRDVSSVEKIAYYTIAECVVVTAVRDGMNLTPYEYIVCRQGSDSTSEVNGPKKSMLVVSEFIGCSPSLSGAIRVNPWNIEATAEALNEAISMSEQEKHLRHEKHYRYVSTHDVAYWSKSFIQDLERACKDHFRRTCWGIGLGFGFRVVALDPHFTKLNMDSIVMAYERSESRAIFLDYDGTLVPQTSISRTPSAEVLRIINTLCSDRRNKVFLVSGRRRDKLGEWFSSCPDLGIAAEHGYFLRWTRDEEWQTCTQTSDFGWMEMAKPVMNLYTEATDGSYIDPKESALVWHHQDADPGFGSSQAKELLDHLESVLANEPVSVKSGQFIVEVKPQGVSKGVVAEKILVSMKERGKQADFVLCIGDDRSDEDMFENIADTIKKGMVATNTSLFACTVGQKPSKAKFYLDDTFEVVTMLSALADATEPEPETDLTDEFDELAVSVSSVDIDDEQTPSDKLIGG

SEQ ID NO: 408 - DNA, 2661 bp, Oryza sativa
atgccttcgctctcctgccacaacctcctcgacctcgttgccgcggcggacgacgcggcgccgtcgcccgcgtcgctgcgcctcccgcgcgtcatgtcggcggcgtcgccggcctcgcccacgtcgccgtccacgccggcccccgcgcggagggtggtcgtgtcgcaccgcctcccgctccgcgccgcggccgacgcggcgtcgccgttcgggttctccttcacggttgactcggacgccgtcgcgtaccagctccgctcggggctgccccccggcgcgcccgtcctccacatcggcacgctcccgccgcccgcaaccgaggcggcctccgacgagctctgcaactacttgctggcgaacttctcttgcctgccggtgtacttgcccgccgatctccaccgccgattctaccatggattctgcaagcactacctgtggcctctcctccattaccttctgccgctcacgccgtcgtcgctgggcgggttgccgttcgaccgcgcgctctaccattctttcctctcggcgaaccgggccttcgccgaccgcctcaccgaggtgctcagccccgacgacgacctcgtctggatccacgattaccacctccttgccctccccaccttcctccgcaagcgattcccgcgcgccaaggtcggtttcttcctccactcgccgttcccctcctcggagatcttccgcaccattcccgtcagggaggacctcctccgcgccctcctcaacgccgacctcgtcggcttccacaccttcgactacgcgcgccacttcctctccgcctgctcgcggctgctcggcctggattaccagtccaagcgcggctacatcggcatcgagtactatggtcgcaccgtcacggtcaagattctgcccgtcgggatcgacatgggccagctgaggtcggtggtgtcggcgccggagacgggggacctggtgcggcggctcaccgagtcgtacaaggggcggcgcctgatggtcggcgtcgacgacgtcgacctgttcaagggaatcgggctcaagttcctggcgatggagcagctgctggtggagcacccggagctgcgcggccgcgcggtgctcgtgcagatcgcgaacccggcgcgcagcgaggggcgcgacatccaggaggttcagggagaagccagggcgatcagcgcccgcgtcaatgcgcggttcggcacgccggggtacacccctatcgtgctgatcgaccgcggtgtgtcggtgcacgagaaggcggcgtactacgcggcggccgagtgctgcgtggtgagcgccgtgcgggacggcctcaaccggataccctacatctacacggtgtgccggcaggagagcactggcctggatgatgcggccaagcgcagcgtcattgtgctgtcggagttcgtcgggtgctccccgtcgctcagcggcgcaatccgggtcaacccatggagtgtggagtctatggcagaggccatgaatgcagccctgaggatgcctgagccagagcagcggctgcgacatgagaagcactacaagtatgtgagcacccatgatgttgcctactgggcgaaatctttcgaccaggacctgcagcgagcttgcaaggatcatttctcgcggcggcattggggtattgggtttgggatgagtttcaaggtggtggcacttggcccgaatttcaggcggctgtctgtcgatcacattgtgccgtcataccggaagtctgataatcgcttaattctcttggactatgatggcacagtgatgccagagggttcaattgataaggcaccgagcaatgaggtcatctctgtattgaatcgtctgtgcgaggaccccaagaacagagtgttcatcgtgagcggtagagggaaggatgaacttggcagatggtttgcaccttgtgagaagctggggattgctgcagagcatggttacttcacaaggtggagcagggactcagcttgggagacctgcgggttggccgtggactttgattggaagaagactgcagaaccagtgatgaggctttacaaggaggcaacagatggttcaaccatcgaagacaaggaaagcgcgttagtttggcaccacgatgaggcagatccagattttggttcatgccaggcaaaggaactgcttgaccacctcgaaaacgttcttgcaaatgaaccagtcgttgttaagaggggccagcatatcgtcgaagtaaatccacagggcatcagcaaaggtgtggttgtggacaacctcttgtcatccatggtgagccgagggaaggcgcccgatttcgtgctgtgcattggggacgaccggtcggacgaggacatgttcgagagcatcgtttgcccgtcgaacagcagcgtcaagctcccggcgagcagcgaggtgttcgcctgcacggtcggcaagaagccgagcatggccaagtactacctcgacgacacggtcgacgtgatcaagatgctgcagggtctcgccaatgcgccatcgcagcggccaagaccgatatggatgcccaaacgccggatagcgccagtgtcgcagaccttggtcctccttatccggctacgtctccactctcttctcttgccggcgcctgacgctgaccggaggatcgccgccgatattggcagcagcagcagcacattcctctcctga

SEQ ID NO: 409 - protein, 886 aa, Oryza sativa
MPSLSCHNLLDLVAAADDAAPSPASLRLPRVMSAASPASPTSPSTPAPARRVVVSHRLPLRAAADAASPFGFSFTVDSDAVAYQLRSGLPPGAPVLHIGTLPPPATEAASDELCNYLLANFSCLPVYLPADLHRRFYHGFCKHYLWPLLHYLLPLTPSSLGGLPFDRALYHSFLSANRAFADRLTEVLSPDDDLVWIHDYHLLALPTFLRKRFPRAKVGFFLHSPFPSSEIFRTIPVREDLLRALLNADLVGFHTFDYARHFLSACSRLLGLDYQSKRGYIGIEYYGRTVTVKILPVGIDMGQLRSVVSAPETGDLVRRLTESYKGRRLMVGVDDVDLFKGIGLKFLAMEQLLVEHPELRGRAVLVQIANPARSEGRDIQEVQGEARAISARVNARFGTPGYTPIVLIDRGVSVHEKAAYYAAAECCVVSAVRDGLNRIPYIYTVCRQESTGLDDAAKRSVIVLSEFVGCSPSLSGAIRVNPWSVESMAEAMNAALRMPEPEQRLRHEKHYKYVSTHDVAYWAKSFDQDLQRACKDHFSRRHWGIGFGMSFKVVALGPNFRRLSVDHIVPSYRKSDNRLILLDYDGTVMPEGSIDKAPSNEVISVLNRLCEDPKNRVFIVSGRGKDELGRWFAPCEKLGIAAEHGYFTRWSRDSAWETCGLAVDFDWKKTAEPVMRLYKEATDGSTIEDKESALVWHHDEADPDFGSCQAKELLDHLENVLANEPVVVKRGQHIVEVNPQGISKGVVVDNLLSSMVSRGKAPDFVLCIGDDRSDEDMFESIVCPSNSSVKLPASSEVFACTVGKKPSMAKYYLDDTVDVIKMLQGLANAPSQRPRPIWMPKRRIAPVSQTLVLLIRLRLHSLLLPAPDADRRIAADIGSSSSTFLS

SEQ ID NO: 410 - DNA, 2583 bp, Oryza sativa
atggtttctcggtcctactccaacctgctggacctggccaccggcgcggcggaccaggcgccggcgccggcggcgctcggcgcgctccggcggcggctgccgcgggtggtgaccaccgcggggctcatcgacgactccccgctgtccccctcgacgccgtccccgtcgccgcggccgcgcaccatcgtggtcgccaaccacctccctatccgggctcaccgcccggcgtcgccgtcggagccgtggaccttctcctgggacgaggactccctcctccgccacctccagcactcgtcctcctcccccgccatggagttcatctacatcggctgcctccgcgacgacatcccgctggccgaccaggacgccgtcgcgcaggcgctcctcgagtcgtacaactgcgtgccggcgttcctgccccccgacatcgccgagcgctactaccatggcttctgcaagcagcatctgtggccgctgttccactacatgctgccgctctcccccgacctcggcggccgcttcgaccgcgcgctgtggcagtcgtacgtgtcggcgaacaagatcttcgcggacaaggtgctcgaggtgatcaacccggacgacgacttcgtgtgggtgcacgactaccacctcatggtgctcccaaccttcctccgcaagcgcttcaaccgcatcaagctcggcttcttcctccactcgccgttcccctcgtcggagatctacaagacgctccccgtccgggaggagctcctgcgcgcgctgctcaactccgacctcatcggcttccacaccttcgactacgcgcgccacttcctctcctgctgcggccggatgctggggctctcctacgagtccaagcgtggccacatctgcttggagtactacggccggacggtgagcatcaagatcctcccggtgggggtgaacatggggcagctcaagacggtgctcgcgttgccggagacggaggcgaaggtggcagagctgatggcgacttactccgggaaggggagggtcgtcatgctgggcgtcgacgacatggacatcttcaaggggatcagcctcaagctgctcgccatggaggagctgctgcggcagcaccccgagtggcgcggcaagctggtgctcgtccaggtcgcgaacccggcgcgcggccgcggcaaggacgtcgacgaggtgaagggggagacgtacgccatggtgcggcggatcaacgaggcgtacggcgcgcccgggtacgagccggtggtgctcatcgacgagccgctccagttctacgagcgcgtggcgtactacgtcgtcgccgaggtgtgcctggtgaccgcggtccgcgacggcatgaacctgatcccctacgagtacatcgtgtccaggcagggcaacgaggcgctcgacaggatgctgcagccgagcaagccggaggagaagaagagcatgctggtggtgtccgagttcatcgggtgctcgccgtcgctgagcggcgcggtgagggtgaacccgtggaacatcgaggccgtggcggacgccatggagagcgcgctcgtgctgccggagaaggagaagcggatgcgccacgacaagcactaccgctacgtggacacccacgacgtgggctactgggcgaccagcttcctgcaggacctcgagaggacgtgcaaggatcacgcgcagcggcggtgctggggcatcggcttcgggctgcggttcagggtggtgtcgcttgacctcagcttcaggaagctcgccatggagcacattgtcatggcgtaccggagggcgaagacgcgcgccatcctgctcgactacgacggcacgctcatgccgcaggcgatcaacaagagcccgagcgccaattccgtcgaaacgctgaccagcttgtgcagggacaagagcaacaaggttttcctctgcagcgggttcgagaagggaacactccatgactggttcccctgcgagaaccttggcttggcggctgagcacggttacttcctgaggtcatcgagggatgcagagtgggagatttccattccccccgcggactgcagctggaagcagatcgcggagccggtgatgtgcctgtacagggagaccacggacggctcgatcatcgagaacagggagacggtgctcgtctggaactacgaggacgcagaccctgacttcggttcatgccaagccaaggagctcgtcgaccacctcgagagcgtgctcgccaacgagcccgtctcggtgaagagcaccggccattccgttgaggtcaagccacagggcgtgagcaagggcctggtggcgcggcggctgctggcgagcatgcaggagaggggcatgtgcaccgacttcgtgctgtgcatcggggacgaccgctccgacgaggaaatgttccagatgatcacaagctccacctgcggcgagtcgctggcggccacggcggaggtcttcgcctgcaccgtcggccgcaagccgagcaaggccaagtactacctcgacgacacggcggaggtcgtcaggctgatgcagggcttggcctccgtctccaacgagctggctcgggcggcgagccccccggaggacgacgacgaatga

SEQ ID NO: 411 - protein, 860 aa, Oryza sativa
MVSRSYSNLLDLATGAADQAPAPAALGALRRRLPRVVTTAGLIDDSPLSPSTPSPSPRPRTIVVANHLPIRAHRPASPSEPWTFSWDEDSLLRHLQHSSSSPAMEFIYIGCLRDDIPLADQDAVAQALLESYNCVPAFLPPDIAERYYHGFCKQHLWPLFHYMLPLSPDLGGRFDRALWQSYVSANKIFADKVLEVINPDDDFVWVHDYHLMVLPTFLRKRFNRIKLGFFLHSPFPSSEIYKTLPVREELLRALLNSDLIGFHTFDYARHFLSCCGRMLGLSYESKRGHICLEYYGRTVSIKILPVGVNMGQLKTVLALPETEAKVAELMATYSGKGRVVMLGVDDMDIFKGISLKLLAMEELLRQHPEWRGKLVLVQVANPARGRGKDVDEVKGETYAMVRRINEAYGAPGYEPVVLIDEPLQFYERVAYYVVAEVCLVTAVRDGMNLIPYEYIVSRQGNEALDRMLQPSKPEEKKSMLVVSEFIGCSPSLSGAVRVNPWNIEAVADAMESALVLPEKEKRMRHDKHYRYVDTHDVGYWATSFLQDLERTCKDHAQRRCWGIGFGLRFRVVSLDLSFRKLAMEHIVMAYRRAKTRAILLDYDGTLMPQAINKSPSANSVETLTSLCRDKSNKVFLCSGFEKGTLHDWFPCENLGLAAEHGYFLRSSRDAEWEISIPPADCSWKQIAEPVMCLYRETTDGSIIENRETVLVWNYEDADPDFGSCQAKELVDHLESVLANEPVSVKSTGHSVEVKPQGVSKGLVARRLLASMQERGMCTDFVLCIGDDRSDEEMFQMITSSTCGESLAATAEVFACTVGRKPSKAKYYLDDTAEVVRLMQGLASVSNELARAASPPEDDDE

SEQ ID NO: 412 - DNA, 2700 bp, Oryza sativa
atgatgtcgaggtcgtacacgaacctgctggacctcgcggcggggaacttcgaggcgctggggccggcggggggagggaggaggaggtcgttcggggcgaagcggatgacgcgggtgatgacggtgcccgggacgctgtcggagctggacgacgaggacgacgagccggcggcgacgagcagcgtcgcctccgacgtgccctcgtcggcggcgtgcgagcgcctcatcgtcgtggcgaaccagctccccgtggtggcgcggcggaggccgggcgccgcggcgggggggtgggcgttctcgtgggacgacgactcgctcctcctccgcctccgcgacggcgtccccgacgagatggaggtgctcttcatcggcacgctccgcgccgacgtgcccgcctgcgagcaggacgaggtgtcgcagagcctcatcgatggattcggatgcgcacccgtgttcctccccgcggggctctacgaccgattctaccagcacttctgcaagggttacctatggccgctgttccactacatgctccccttcgcctccgccttgccggcggccgcatccggcgatggccggtttgaccgcggcgcgtgggaggcctacgtgctcgccaacaaatacttcttcgagaaggtggtcgaggtcatcaacccggaggacgactacgtttgggtccacgattaccacctcatggcgctgcccaccttcctccgccgccgcttcaatcgcctccgcatcgggttcttcctccacagcccctttccctcatcggagatctaccgctcgctgcccgtccgagaggagatcctaagaacgctgcttaattgcgatctcattggattccacacattcgattatgcgaggcacttcctatcttgctgtagtaggatgctggggatagagtaccagtcaaagcgtggatacattggattggattactttggccgcactgttggaatcaagatcatgccagtgggaatccatatgggtcaattgcaatcagtgttgcgattgtccgagaaagaaaagaaggttgctgagctgcggcagcaattcgagggcaagtccgtgttacttggtgtggatgatatggatatcttcaagggaatcaacttaaaacttcttgcgtttgagaatatgctgaggacgcatcccaagtggaagggaagagctgtgttggtgcagattgcaaacccagcacgagggaagggaaaggatctggaggctgtccaggctgagattcgggagagttgtgatagaattaacaaggagtttggccagtcaggttacagtccagtgattttcattgaccagagcgtgccaagtgcggtgaggcttgcatattatacggttgctgagtgtgttgtggtgacggctgtgagggatgggatgaatttgaccccatatgaatacattgtctgccgggaggggatacctggctctgagtgtgcaccagaggtgagtggaccaaagaagagcatgttggttgtgtcggagtttattggttgctcaccttcactgagtggagccattcgtgttaacccgtggaatatcgaggcaactgcagaggcactgaatgaggccatctcaatgtcagagcgtgaaaagcagctgaggcacgaaaaacattaccgttatgtcagcacccatgatgttgcatattggtctaagagctttgtacaggacctggagagggcttgcaaggatcactttaggaaaccatgctggggcattggattgggatttggcttcagggtggtagccctagacccacatttcacaaagcttaatttcgattcaattataatgtcctatgagagatcaaagagtagggctatatttctcgactatgatggcacattggtgccacaggcttcgctcaacaagaatccaagtgaagaattactgaggatcattaataccctatgcgcagatagaaataacaccgtgttcattgtcagcgggagaagcaaggatgacttgagcaaaaagcttatctcatgtccaaagctaggcattgccgcagagcatggctacttcttaaggtggactagagatgaagaatggcaaaccactgcacagacctcagattttggatggatgcaaatggcgaagccagtgatggatctttatactgaatcaactgacggatccaccattgagactaaagaaactgcactggtgtggcaccatcaggatgctgaccaaggttttggctcttcccaggcaaaggaaatgcttgatcacttggaaagtgtattagcaaatgaaccagtctcagtcaagagtggccaattcattgttgaagtcaaacctcagggtgttaccaaagggctcatagctgagaaagtactcacatcaatgaaggagaaggggcaactggcagattttgtattatgcattggtgatgacaggtcagatgaggatatgtttgaaaatattgccgatgtcatgaaaaggagcattgttgcaccaaaaactccactgtttgcatgtactgtgggccagaagccaagcaaagctaggttttacctggatgatacatttgaagtcgtcaccatgttgagttcactggcggatgcttcagaaccagaccttatggcagacttggaagatgacttggccacatcagtctcatcaatagaaataagtgacagagtggtatcttttagtaatttaaggacagaaggatcttag

SEQ ID NO: 413 - protein, 899 aa, Oryza sativa
MMSRSYTNLLDLAAGNFEALGPAGGGRRRSFGAKRMTRVMTVPGTLSELDDEDDEPAATSSVASDVPSSAACERLIVVANQLPVVARRRPGAAAGGWAFSWDDDSLLLRLRDGVPDEMEVLFIGTLRADVPACEQDEVSQSLIDGFGCAPVFLPAGLYDRFYQHFCKGYLWPLFHYMLPFASALPAAASGDGRFDRGAWEAYVLANKYFFEKVVEVINPEDDYVWVHDYHLMALPTFLRRRFNRLRIGFFLHSPFPSSEIYRSLPVREEILRTLLNCDLIGFHTFDYARHFLSCCSRMLGIEYQSKRGYIGLDYFGRTVGIKIMPVGIHMGQLQSVLRLSEKEKKVAELRQQFEGKSVLLGVDDMDIFKGINLKLLAFENMLRTHPKWKGRAVLVQIANPARGKGKDLEAVQAEIRESCDRINKEFGQSGYSPVIFIDQSVPSAVRLAYYTVAECVVVTAVRDGMNLTPYEYIVCREGIPGSECAPEVSGPKKSMLVVSEFIGCSPSLSGAIRVNPWNIEATAEALNEAISMSEREKQLRHEKHYRYVSTHDVAYWSKSFVQDLERACKDHFRKPCWGIGLGFGFRVVALDPHFTKLNFDSIIMSYERSKSRAIFLDYDGTLVPQASLNKNPSEELLRIINTLCADRNNTVFIVSGRSKDDLSKKLISCPKLGIAAEHGYFLRWTRDEEWQTTAQTSDFGWMQMAKPVMDLYTESTDGSTIETKETALVWHHQDADQGFGSSQAKEMLDHLESVLANEPVSVKSGQFIVEVKPQGVTKGLIAEKVLTSMKEKGQLADFVLCIGDDRSDEDMFENIADVMKRSIVAPKTPLFACTVGQKPSKARFYLDDTFEVVTMLSSLADASEPDLMADLEDDLATSVSSIEISDRVVSFSNLRTEGS

SEQ ID NO: 414 - DNA, 2475 bp, Oryza sativa
atgccctccctccccaactccggcgacgagggcggcgccccgcctccgactccgccgccgccgggggcgcgccgcgtggtggtcgcccaccgcctccccctccgcgcggatcccaatccgggcgcgccgcacgggttcgacttctccctcgacccgcacgcgctcccgctccagctctcccatggcgtcccccgccccgtcgtcttcgtcggcgtgctcccctccgccgtcgccgaggccgtccaggcgtccgacgagctcgcggccgatctcctcgcgcggttctcatgctacctggtgttcctccccgccaagctccacgccgacttctacgacggcttctgcaagcactacatgtggccgcatctccactatctcctcccgctcgcgccctcctacggcaggggcggcggcctccccttcaacggcgacctctaccgcgccttcctcaccgtcaacacccacttcgccgagcgcgtgttcgagctcctcaaccccgacgaggacctggtgttcgtccacgactaccacctctgggcgttccccaccttcctccgccacaaatccccgcgcgcccgcataggtttcttcctccactctcccttcccctcctccgagctcttccgcgccatccccgtccgcgaggacctcctccgcgccctcctcaacgccgatctcgtgggcttccacaccttcgattacgcgcgccacttcctctccgcgtgctccagggtcctcggcctctccaaccgctcgcgccgcggctacatcgggatcgagtacttcggccgcacggtggtcgtcaagatcctctccgtcggcatcgacatgggccagctccgcgcggttctgccgttgccggagacggtcgccaaggccaacgagattgctgacaagtacaggggacgacagctgatgctcggcgtggacgacatggatttgttcaaggggattgggctcaagctcttggccatggagaggctgctggagtcgcgggcggacttgcgtggccaggtggtcctcgtgcagatcaacaacccggcgcggagccttggccgcgacgtcgacgaggtccgcgcggaggtgctggcgatccgtgaccggatcaatgcccggttcggctgggcggggtacgagccggtggttgtgatcgacggcgccatgccgatgcacgacaaggtggcgttctacacgtccgcggacatctgcatcgtgaatgccgtgcgcgacgggctgaacaggataccgtacttctacaccgtgtgccggcaggagggcccggttcccaccgctcctgccgggaagccgaggcagagcgccatcatcgtgtcagagtttgtcgggtgctcgccgtcgctgagcggcgcgatccgcgtcaacccctggaacgtggacgacgtcgcggacgccatgaacacggcgctgaggatgagcgacggcgagaagcagctgcgccaggagaagcactacaggtacgtgagcacgcacgacgtcgtctactgggcgcagtcgttcgaccaggacctgcagaaggcctgcaaggacaactcgtccatggtgatcctcaacttcggcctcggcatgggcttccgcgtcgtcgcgctcggccccagcttcaagaaactctcacccgagctcattgaccaagcataccgccagactggcaacaggctcatcttactggactacgatggcacagtgatgccacaggggctgatcaacaaggcgcccagtgaggaagtgatccgtactctgaatgaactgtgctctgatccgatgaacaccgttttcgtcgtcagcgggcggggcaaggatgaactggctgaatggtttgcaccatgcgacgagaagctggggatctctgcagagcacggctacttcacaaggtggagcagggattctccctgggagtcatgcaagttggtgacacattttaattggaagaacatcgcagggcctgtaatgaagcactacagtgatgcaaccgatgggtcatacatcgaggttaaagaaacatcactagtgtggcactatgaggaagccgatccggattttggatcatgccaggccaaagagctccaggaccacctgcagaatgtgcttgcgaacgagccagtctttgtgaagagcggccatcagattgtggaagttaatcctcagggtgtgggcaaaggagtcgccgtgcgtaatctcatttcaaccatgggaaatcgtggcagcttgccagatttcatcctctgcgtcggcgatgaccggtcggatgaagacatgttcgaggctatgatcagcccttcgcctgcgttcccggagactgcacagatcttcccctgcactgttggcaacaagccgagcttggccaagtactacctggatgacccggctgatgttgtgaagatgctccagggcctgacggactcgccgacccagcagcaaccgcggccccccgtctcgttcgaaaactcgctagatgattga

SEQ ID NO: 415 - protein, 824 aa, Oryza sativa
MPSLPNSGDEGGAPPPTPPPPGARRVVVAHRLPLRADPNPGAPHGFDFSLDPHALPLQLSHGVPRPVVFVGVLPSAVAEAVQASDELAADLLARFSCYLVFLPAKLHADFYDGFCKHYMWPHLHYLLPLAPSYGRGGGLPFNGDLYRAFLTVNTHFAERVFELLNPDEDLVFVHDYHLWAFPTFLRHKSPRARIGFFLHSPFPSSELFRAIPVREDLLRALLNADLVGFHTFDYARHFLSACSRVLGLSNRSRRGYIGIEYFGRTVVVKILSVGIDMGQLRAVLPLPETVAKANEIADKYRGRQLMLGVDDMDLFKGIGLKLLAMERLLESRADLRGQVVLVQINNPARSLGRDVDEVRAEVLAIRDRINARFGWAGYEPVVVIDGAMPMHDKVAFYTSADICIVNAVRDGLNRIPYFYTVCRQEGPVPTAPAGKPRQSAIIVSEFVGCSPSLSGAIRVNPWNVDDVADAMNTALRMSDGEKQLRQEKHYRYVSTHDVVYWAQSFDQDLQKACKDNSSMVILNFGLGMGFRVVALGPSFKKLSPELIDQAYRQTGNRLILLDYDGTVMPQGLINKAPSEEVIRTLNELCSDPMNTVFVVSGRGKDELAEWFAPCDEKLGISAEHGYFTRWSRDSPWESCKLVTHFNWKNIAGPVMKHYSDATDGSYIEVKETSLVWHYEEADPDFGSCQAKELQDHLQNVLANEPVFVKSGHQIVEVNPQGVGKGVAVRNLISTMGNRGSLPDFILCVGDDRSDEDMFEAMISPSPAFPETAQIFPCTVGNKPSLAKYYLDDPADVVKMLQGLTDSPTQQQPRPPVSFENSLDD

SEQ ID NO: 416 - DNA, 2592 bp, Oryza sativa
atggtttcaaagtcatatacaaatcttctagatatgagtggtgaagatgtgtttgactttcagcaaccatttagatcgcttcctcgttttgtgacttccccaagcatcacatctaatcctgattgggatacaagtaatgctgatgattcagttggtcctgcatcttgctgtgtaaggaaaataatcgtctccaactttcttccactaaactgtaccaaagatgaagctactggacagtggtccttctcaatggatgacaatcaacttcttgttcaacttaaagatggatttccaatggagagcgaagttgtttatgtgggtagcttgaacgctgaagttgatcctggtgagcaagatcaactttcacagaaacttttcagagaatacaaatgcatacctactttcctcccagctgacctccagcagcagttctatcatggattctgtaaacaacaattatggccacttttccattatatgcttcctatttgcctcgacaaaggcgagctctttgaccgctctctatttcaagcctatgttcgggcaaacaaaatatttggtgacaaagttatggaggccatcaattcagatgatgactgtgtgtgggttcatgattatcacctcatgcttctcccaacctttttaagaaaaaagcttcatcgcatcaaaattggtttcttccttcacagtccatttccctcctctgaaatctataggacactgccagtaagagatgaaattttgaagtctcttctgaatgctgatctcattggctttcaaacatttgactatgcccgccacttcctttcatgttgcagcagattgttaggccttaattacgagtcaaaacgtggtcacatcggtatagagtactttggccgtacggtgagcctcaagatccttgctgtgggtgtacatgttggtcgtcttgagtctgtgttgaggctgcctgccacaattagcaaggttcaagaaattgagcaaagatataagggtaagatggtgatgttgggtgtagatgatatggatatcttcaaagggatcagtctaaaattgcttggcttggaatttcttttggagagaactccaaagctaagagggaaggttgtccttgtgcagattataaatcctgcaagaagcactggaaaagatgtggaggaagcaataaatgaagccgtctctgtagctgaaaggataaacattaagtatggttctgctgagtacaagcctgtcatccttatcgactaccccataccttcttatgagaagattgcatactatgctgcatctgattgctgtattgtaaatgctgtgagggatgggatgaacttgataccatatgagtatactgtctgcaggcagggaaatgaggagattgataagctcagaggtgttgataagagctcacatcacacaagcacactaattgtgtctgagtttgttggttgctccccatcacttagtggtgctttcagggtaaatccttggagtattgaagatgtagctgatgcattatataaagcaatggatttgactcaatcggagaggaaattgcgtcatgataagcattatcgctacgtcaaaactcatgacgttgcttactgggcgcgcagtttttcccaagatctagatagagcgtgcaaggatcactatagccgaaggtgttggaccactgggtttggtttgaattttagagtcattgctctttctcctggatttagaaggctatctttggaacactttgcttcttcttataagaagactaatagaaggctgatatttatggattatgatggcacccttgtcccccagtcatcagtcaacaaagttccaagtgcagaagtcatttctatccttacaagcttgtgcaatgatccaaagaactgtgtgttcatagtcagcggaagagatcgtactaccctaagtgagtggtttgcttcatgtgataagcttggtattgcagctgaacatggctattttatcaggtggaacaaagaaggtgaatgggaaacaagctcctcagctcaagattgtgaatggaagaacatcgccgagcctatcatggaagtatacaaggaaacaaccgatgggtctgccatagagacaaaggagagtgggctagtttggcattatcaggatgcagatcatgacttcggttcatgccaggcgaaggagctagtgagtcatcttgagagggtgctggcaaatgaacctgttgtggttaaacgtggtcatcaaatcgtagaagttaagccccagggtgttagcaaggggattgctgtggacacagtcattcggacggtaatcaacaacgaaaacgcaccggattttctgatgtgcattggtaacgatcgatcggacgaggacatgtttgagagcatcaatgaagccgtctcacgttctgtgtttcctactgctccagatgtctttgcctgctctgttggccagaaggctagcaaagcgaagtactatgtggatgggtgcagtgaggtgatcagattactcaagggtgtaaccgccattacaccccgaagggaggtgatcagccagagtcaagtaacattcagggatatacttgaggttgtcagctga

SEQ ID NO: 417 - protein, 863 aa, Oryza sativa
MVSKSYTNLLDMSGEDVFDFQQPFRSLPRFVTSPSITSNPDWDTSNADDSVGPASCCVRKIIVSNFLPLNCTKDEATGQWSFSMDDNQLLVQLKDGFPMESEVVYVGSLNAEVDPGEQDQLSQKLFREYKCIPTFLPADLQQQFYHGFCKQQLWPLFHYMLPICLDKGELFDRSLFQAYVRANKIFGDKVMEAINSDDDCVWVHDYHLMLLPTFLRKKLHRIKIGFFLHSPFPSSEIYRTLPVRDEILKSLLNADLIGFQTFDYARHFLSCCSRLLGLNYESKRGHIGIEYFGRTVSLKILAVGVHVGRLESVLRLPATISKVQEIEQRYKGKMVMLGVDDMDIFKGISLKLLGLEFLLERTPKLRGKVVLVQIINPARSTGKDVEEAINEAVSVAERINIKYGSAEYKPVILIDYPIPSYEKIAYYAASDCCIVNAVRDGMNLIPYEYTVCRQGNEEIDKLRGVDKSSHHTSTLIVSEFVGCSPSLSGAFRVNPWSIEDVADALYKAMDLTQSERKLRHDKHYRYVKTHDVAYWARSFSQDLDRACKDHYSRRCWTTGFGLNFRVIALSPGFRRLSLEHFASSYKKTNRRLIFMDYDGTLVPQSSVNKVPSAEVISILTSLCNDPKNCVFIVSGRDRTTLSEWFASCDKLGIAAEHGYFIRWNKEGEWETSSSAQDCEWKNIAEPIMEVYKETTDGSAIETKESGLVWHYQDADHDFGSCQAKELVSHLERVLANEPVVVKRGHQIVEVKPQGVSKGIAVDTVIRTVINNENAPDFLMCIGNDRSDEDMFESINEAVSRSVFPTAPDVFACSVGQKASKAKYYVDGCSEVIRLLKGVTAITPRREVISQSQVTFRDILEVVS

SEQ ID NO: 418 - DNA, 2658 bp, Oryza sativa
atggtttcgagatcctactccaacttgctggagctcgccgccggcggaggaggaggaggcggcggcgaagggccgctgccgtcgctggggcggcgacggattccgcgggtggtgacggcgtcgggcattgtcccggacctggactactccgacgacgacgcggcgtcggcggcgtcgtcgtccgaccactcctccgcccactcccacgcgccgcgcgagcgcgccatcatcgtcgccaaccagctgcccatccgcgcgtctcgccgcggcggcggcggcggcgggtgggagttctcctgggacgaggacagcctcctcctgcagctcagggacagcctccgcgcccacgccgaccgcgccgacgacatggagttcgtctacgtcggcggcctccgcgacgacgtgcccgcggcggagcacgacgaggtggcgcaccacctcctcgagggcttccgctgcgtgcccaccttcctccccgccgacctccggtcgcggttctaccacggattctgcaagcagcagctgtggccactgttccattacatgctcccgctgtcgccggagctcggcggccgcttcgaccgcgcgctgtggcaggcgtacgtgtccgtcaacaagatcttcgccgacaagatactggaggtgatcagccccgacgaggactacgtctgggtgcacgactaccatctcatgatcttgccgacgttcctgcggaagcggttcaaccgcgtcaagctcggcttcttcctccacagcccgttcccgtcgtcggagatctacaagaccctgcccgtccgcgaggagctgctccggtcgctcctgaacgccgatttgatcgggttccacaccttcgattatgccaggcatttcctgtcctgctgtggaaggatgctcgggttgaagtatgagtcgcagaggggctacattgcgctggagtattatggtcggacggttaccatcaagatattgccggtgggagttcatttggagcagctgcggtcggtgctcaatcttccggagacgggggtcaaggtggccgagcttctcaagcaattctgcgatcagaaccggctgatgttgcttggcgtagatgatatggacatctttaaaggaattagcttgaagcttttggcatttgagcagctcctgatgcaacatcccgaatggcgaggaagggtggttctagtacagattgccaatccagcgaggggacgggggaaagatgtgaaagaggtgcaggatgagagctatgcaatggtgaggcgtatcaatgaggcatttgggcagccaggttaccagccggttatattgatcgatcggccacttcagttctatgagagaatggcttactatgttgtcgctgagtgctgcctggtgaccgcagtgagagatggcatgaatcttatcccgtatgagtatgtaattgctaggcagggcaatgaaaaactagacgggatcttaggtcttggcccatcggcacggaagaagagcatgcttgttgtgtcagagttcatcggctgttcaccttccctaagtggtgcgattcgggtaaacccttggaacatcgatgctgtggctgatgcaatggactctgctttagagatgcctgaaggggagaaggtgctgagacatgagaagcaccacaaatatgtgagcacacatgatgttggatactgggcaaacagcttcttgcaagatctggagaggacttgtctggaccatagcaggaggcgttgttgggggataggattcgggctaaggtttagggttgtagcccttgatccaaacttcaagaagcttgcagttgagcaccttgtctcagcctaccggaggacgaccacgcgaatcattcttttggactatgacgggacgctgatgcctcaaacatcatttggtaagagcccaagctctaaaacgatagatatgctgaacagcctgtcccgtgatcagaacaacatggtcttccttgtgagcacaaagaagcggtcgactctagaagaatggttctcatcatgcgacaacctaggcttagctgctgagcatggatactttctcaggctgaagagagatgcagaatgggagacgtgtgtcccagtgacagacagaagctggaagcaaatcgcagagcctgtgatgaaaacatacaccgagacaacagatgggtcaacaattgaggacaaggagaccgcgatagtgtggagctacgaggatgctgatcctgattttggatcttgccaagccaaggagctccatgaccatctggagagtgtccttgcaaatgagccagttacagtaaaagctggcctgaaccatgtcgaggtgaagccacagggtgtaagcaagggccttgtggcaaaacggcttttgtcgataatacgggagaacagcctccttccggactttgtcctctgcatcggtgatgaccgctccgatgaagacatgttcgaggtgatcaccactgcagcacaggacaactgcctaagcccagacgccgaggtcttcgcctgcaccgttggtcgcaagcccagcaaggccaagtactacctggatgacctggccgacattgtgaggctgatccagggcctcgccaatgtctctgacgagatgcacagcacaatgcccacacctgtcgacgccgcagacaccgccctgaggtga

SEQ ID NO: 419 - protein, 885 aa, Oryza sativa
MVSRSYSNLLELAAGGGGGGGGEGPLPSLGRRRIPRVVTASGIVPDLDYSDDDAASAASSSDHSSAHSHAPRERAIIVANQLPIRASRRGGGGGGWEFSWDEDSLLLQLRDSLRAHADRADDMEFVYVGGLRDDVPAAEHDEVAHHLLEGFRCVPTFLPADLRSRFYHGFCKQQLWPLFHYMLPLSPELGGRFDRALWQAYVSVNKIFADKILEVISPDEDYVWVHDYHLMILPTFLRKRFNRVKLGFFLHSPFPSSEIYKTLPVREELLRSLLNADLIGFHTFDYARHFLSCCGRMLGLKYESQRGYIALEYYGRTVTIKILPVGVHLEQLRSVLNLPETGVKVAELLKQFCDQNRLMLLGVDDMDIFKGISLKLLAFEQLLMQHPEWRGRVVLVQIANPARGRGKDVKEVQDESYAMVRRINEAFGQPGYQPVILIDRPLQFYERMAYYVVAECCLVTAVRDGMNLIPYEYVIARQGNEKLDGILGLGPSARKKSMLVVSEFIGCSPSLSGAIRVNPWNIDAVADAMDSALEMPEGEKVLRHEKHHKYVSTHDVGYWANSFLQDLERTCLDHSRRRCWGIGFGLRFRVVALDPNFKKLAVEHLVSAYRRTTTRIILLDYDGTLMPQTSFGKSPSSKTIDMLNSLSRDQNNMVFLVSTKKRSTLEEWFSSCDNLGLAAEHGYFLRLKRDAEWETCVPVTDRSWKQIAEPVMKTYTETTDGSTIEDKETAIVWSYEDADPDFGSCQAKELHDHLESVLANEPVTVKAGLNHVEVKPQGVSKGLVAKRLLSIIRENSLLPDFVLCIGDDRSDEDMFEVITTAAQDNCLSPDAEVFACTVGRKPSKAKYYLDDLADIVRLIQGLANVSDEMHSTMPTPVDAADTALR

SEQ ID NO: 420 - DNA, 2427 bp, Physcomitrella patens
atgtcggaggggagtcgaatgcttgtcgttgcgcgcatgttgccattgaacgctgtgccccatccgaatgggaatagctacttattcgagtgggacaaagactcgttgctttggcagcttagagatggattgcggcctggaatggaggttatctatgtaggctgtttgaaggtggaggtggaagacgctgatcaggacgagattgcggccatgctcctggaaaattttaattgcgttcctgcttttctacccaacgaactgaaaagtaggttttatcatgggttttgcaagcagatgttgtggccccttttccactatctgttacctctcagtcctgagcatgggggtcgattcaaacgctcatggtggcaagcatatgtgtccgtcaacaagatttttgccgacaaggtgatggaggtgattagtcccgacgatgactatgtgtgggtgcatgactaccatctcatggttttgcccacttttttgcgtaagcgattcaataaagtgaggctcggtttctttttgcacagcccgtttccttcgtccgagatttacaggacgctgccggtgcgtgacgagatacttagagctctattaaatgcagacttgatagggtttcatacatttgattatgcgaggcactttttatcatgttgcagccgtatgttaggtctggagtacgcatctaagcgggggcacattgggttagaatattatggccgcaccgtgggcatcaaaattatgcccgtcggtatccacatgggtcagttcgatgcaagcttgaagcttgctgatacaaagtggcgtattggtgagatcagggaaaagtacaagggaatgtcggttcttcttggggtagatgacatggacattttcaagggcattgggctgaagttcttggctatggaggagcttctcaggcaacacccacagtggcaagggaaggttgtcatgatacaaattgctaatcctgcgaggggtagtggcaaagatattgacgaagctcgtgaagaggcctatactatagccaaaaaagtgaatgaagagtttgggaatgagcgttataccccgattgtcttggaggagaggcacgtgcccctgtttgagcgaattgcgtattacaccatcgcagagtgctgtgttgtgacggcagtgcgtgatgggctcaatctcatcccgtacgagtacatcgtatgtagggaaggagctcctcagatgtcagaatcggaaaattatcttgaagaatcatctgtcaagaaaagcatgttgatagtgtctgagttcatcggatgctcgccatctctgagtggtgccattcgggttaatccctggaacattgagatggttgcagaggctatgaatagtgcgatcacgatgaaagagcaagagcaacacctgcgccatgagaagcattacaggtatgttagtacgcatgatgttgcgtactgggccaaaacctacacgtcggatttggaaagaacttgccgcgatcacaataaacgccggtgctatgggattgggttcggattaggtttccggatcgtagctctggatccgagctttaagaagttgcgcaccgaacttattgtcggagcatacgggaagagtgccaccagagccttacttttggattatgatggtacagtgatgcctacatcacacgaagagagtcctagtcccgaggttttggatcttttaaatacgctttgcaacgacccaaagaacacacttttcatcgtaagtgggcgtccacggaataagcttggggaatggtttagttcctgcgagttacttggtcttgctgctgaacatggatacttttacaggtacaaatgggatcggttgagtgttgttgagcgtgaagcgccgtccacgagctttgattggaaactgattgcagggccagtcatgcaactttacaccgagtcaacagatggctcctatattgaggccaaagaaagtgcattggtgtggcattatcgagatgcagaccatgactttggagcttggcaggctaaagagttgcaagatcaccttgaaagtgtactagccaatgagccagtcacggtgaagagtggtgcgcaaattgtggaagttacacctcagggggtgagtaagggaattatggtggagaagttgctattaatgatggagaagaagaatggagccttgccagacatggtactgtgtgtgggtgacgatcggtcagatgaggacatgtttgagagcattgaatccctcatgcgtggcgcccccagtgccgaggtatttgcatgcactgtgggtcagaaacccagtaaagccaagtactatttggatgatgttggggaggtaatcaagatgctacaggggttggcaaatgcctctattaggtcctctgcttcatcacttcctcagctttctgatttctcatctcttcatatttag

SEQ ID NO: 421 - protein, 808 aa, Physcomitrella patens
MSEGSRMLVVARMLPLNAVPHPNGNSYLFEWDKDSLLWQLRDGLRPGMEVIYVGCLKVEVEDADQDEIAAMLLENFNCVPAFLPNELKSRFYHGFCKQMLWPLFHYLLPLSPEHGGRFKRSWWQAYVSVNKIFADKVMEVISPDDDYVWVHDYHLMVLPTFLRKRFNKVRLGFFLHSPFPSSEIYRTLPVRDEILRALLNADLIGFHTFDYARHFLSCCSRMLGLEYASKRGHIGLEYYGRTVGIKIMPVGIHMGQFDASLKLADTKWRIGEIREKYKGMSVLLGVDDMDIFKGIGLKFLAMEELLRQHPQWQGKVVMIQIANPARGSGKDIDEAREEAYTIAKKVNEEFGNERYTPIVLEERHVPLFERIAYYTIAECCVVTAVRDGLNLIPYEYIVCREGAPQMSESENYLEESSVKKSMLIVSEFIGCSPSLSGAIRVNPWNIEMVAEAMNSAITMKEQEQHLRHEKHYRYVSTHDVAYWAKTYTSDLERTCRDHNKRRCYGIGFGLGFRIVALDPSFKKLRTELIVGAYGKSATRALLLDYDGTVMPTSHEESPSPEVLDLLNTLCNDPKNTLFIVSGRPRNKLGEWFSSCELLGLAAEHGYFYRYKWDRLSVVEREAPSTSFDWKLIAGPVMQLYTESTDGSYIEAKESALVWHYRDADHDFGAWQAKELQDHLESVLANEPVTVKSGAQIVEVTPQGVSKGIMVEKLLLMMEKKNGALPDMVLCVGDDRSDEDMFESIESLMRGAPSAEVFACTVGQKPSKAKYYLDDVGEVIKMLQGLANASIRSSASSLPQLSDFSSLHI

SEQ ID NO: 422 - DNA, 2565 bp, Populus tremuloides
atgataacacagtcttgcaaggacaatttggatatgatttcggtcaacgattttcgtgtcgtggaccgaatccctcgtatcatgaatgtgctgggagctctctctgaaatcgaggttggtgagcatgatgatgaaggcgtaaccagtcctgtcgtgtccaagccgcgccgaatcatggtggccaatcagctaccgataagagggcaccgtaatgaagaaacaaaaggttggtcttttgaacttgataaagagagtcttgttttgcagtttaaagatggatttcctgcaaattcagaagtttggtacgtggggttgttgaaggttgatgttgaaacgaaagatcaggatgaggttgcgcggttgttgttttctatgtttagatgtgttcctgttttcttgactgatgatcagaagaacaagtattatcatggcttctgtaagcactatttatggcctttgtttcattatatgttgcctttgtctcctagtcgtggtggtgtacgttttgataggtcgctttgggaggggtatatagtagctaataggttatttgcaaacaaggttactgagattttgaggcatcatgaggattctgtttgggtgcatgattatcatcttatggtgctgcctgctttcttgaggaagaggtttaacagagttaaacttggcttcttcttgcatagtccgttcccatcatctgagatatacacgactatacctgtcagggaggagattttgaggtctcttttgaattgtgatcttatcgggtttcatacttttgattatgctaggcatttcttgtcttgttgtagcaagatgttgggtattgattatcagtgcaaaaggggttacattggcctggattactgtggtaagactatcagtatcaagatcttacatatgggaattcatatgggacagcttgagtcggttttgaatatggagcagacagccactttggccaaacaattgaaggagaaatttgaagggaaaattgtaatggttggtgtggatgatttggatttgcttaaaggtattagctcgaagttctcagcgatggggagacttttggaaatgcgtccggaactgatagggaaagtggtattagtccagattgctaatccggctaggagtcagggtaaggatgtgcaagaagtccaaaaagagactactcttattgctcaacagatcaatcaaaagtatggttacgaaggttatcagccaattgttttcattaatggtccagttagcactctagagaaagcagcatactatgcgatatctgaatgttgtgtggttaatgctttaagggatgggatgaatttggtttcatacaaatacactgtttgtaggcaaggcagccctgttttagacaaggcattggggattgatgaatcgtatccaaggaaaagtttcctaattgtgtcagaattcattggatgctcaccgtctctcagtggggcacgtcgtgttaatccttgggacgtaggtgctgtggccgatgccatgtatgcgggtatccatatgaaggatgaagagaaacatttgcgccacgagaagcactataagtacattagctctcacgatgttgctttttgggcgaggagttttgatctggaccttgagagggcttgcaaagatcattatctcaagaggtattacaatgttgggtttggtttgaatttcagagttgctgctgtgggaacaaattttaggatgctcacgactgaaagagttgttgctgcctataacaatacaaacagccgcttaatccttttagactatgatggcactatgatgccacagtgtgctgttgacaaaacacccagaagtgaagttatttcaatcctgaattgcttatgcagtgatcccaaaaacgttgttttcattgtgagtggcagaggaagggatcctctaagcaagtggttctccccatgtgagacattgggtatatcagccgagcatggttactttaccaggtggacaaagaattctccatgggagacttgctcggtggcaatggattgtgattggaaaaagatcgtacaacctgtcatggagcgttatacagagacaaccgatgggtctttcatagagccaaaagaaagcgcactagtgtggcaccatcaagacgcagaccctgatttcggcagctgccaggctaaagagcttcttgatcacttggagagtgtccttgctaacgagcctgtggtggttagaagaggccagcagattgttgaggtgaaaccacagggagtaagcaaaggtatagttgtagaaaaccttatttcaaccatgcgaagtcagggcaagtcaccggatttcctgttctgcatcggggatgataggtccgatgaggacatgtttgagagcattgcaagacttgttgacaatccatcaataccacccattgcagaagtgtttgcctgcactgttggtcttaagccaagcaaggctaaatactatcttgatgatacgcctgaggtcatcaagttgcttcaaggccttgctacagcatcagtagggtcaaagtatgcacatactcttgaagatgaagatgtctaa

SEQ ID NO: 423 - protein, 854 aa, Populus tremuloides
MITQSCKDNLDMISVNDFRVVDRIPRIMNVLGALSEIEVGEHDDEGVTSPVVSKPRRIMVANQLPIRGHRNEETKGWSFELDKESLVLQFKDGFPANSEVWYVGLLKVDVETKDQDEVARLLFSMFRCVPVFLTDDQKNKYYHGFCKHYLWPLFHYMLPLSPSRGGVRFDRSLWEGYIVANRLFANKVTEILRHHEDSVWVHDYHLMVLPAFLRKRFNRVKLGFFLHSPFPSSEIYTTIPVREEILRSLLNCDLIGFHTFDYARHFLSCCSKMLGIDYQCKRGYIGLDYCGKTISIKILHMGIHMGQLESVLNMEQTATLAKQLKEKFEGKIVMVGVDDLDLLKGISSKFSAMGRLLEMRPELIGKVVLVQIANPARSQGKDVQEVQKETTLIAQQINQKYGYEGYQPIVFINGPVSTLEKAAYYAISECCVVNALRDGMNLVSYKYTVCRQGSPVLDKALGIDESYPRKSFLIVSEFIGCSPSLSGARRVNPWDVGAVADAMYAGIHMKDEEKHLRHEKHYKYISSHDVAFWARSFDLDLERACKDHYLKRYYNVGFGLNFRVAAVGTNFRMLTTERVVAAYNNTNSRLILLDYDGTMMPQCAVDKTPRSEVISILNCLCSDPKNVVFIVSGRGRDPLSKWFSPCETLGISAEHGYFTRWTKNSPWETCSVAMDCDWKKIVQPVMERYTETTDGSFIEPKESALVWHHQDADPDFGSCQAKELLDHLESVLANEPVVVRRGQQIVEVKPQGVSKGIVVENLISTMRSQGKSPDFLFCIGDDRSDEDMFESIARLVDNPSIPPIAEVFACTVGLKPSKAKYYLDDTPEVIKLLQGLATASVGSKYAHTLEDEDV

SEQ ID NO: 424 - DNA, 2562 bp, Populus tremuloides
atgatgtctagatcatataccaatctattagatctagcttctggtaactttccggcaatgggtcaacctcgggagagaaagcggttgcctcgtgtaatgacagttccgggggttatttctgagcttgatgatgatgtggctaatagtgtgacctcagatgtaccttcatcggtagttcaggaccggataatcattgtagggaatcagttgccggtaaaagcaaagcgcagaccggataataaaggatggagctttagttgggatgaggattcgttgttattgcagttaaaagatggcttgcctgaagaaatggaggttttatatgtcggttctttgcgggcagatattgatttgagtgaacaagaggatgtctcacagatcttgttggacaggttcaagtgtgtaccagcatttctgcctcctgatattttgtccaagttttatcatgggttttgtaaacagtatttgtggccactttttcattacatgcttcctatttcgggtaatcatggtgggcgatttgatcggtctttgtgggaggcatatgtggcagcaaataagatcttctcgcaaagggtgattgaagttataaatccagaggatgactatgtttggattcatgactatcatttgatggtgctgcctacattcttgaggagaaggttcaatagattgagaatgggattctttcttcacagtccatttccttcatctgagatatataggactttgcctgttagggaagagatccttaaggcactgttgaattcggacctcattggttttcacacttttgattatgcccgacattttctatcttgttgcagtcggatgttggggttggagtatcagtcaaagaggggttacattgggttagagtattatggcaggactgttggaataaagatcatgccagttgggatacatatggggcagattcagtctgtcttgaaacttgcggataaggattggagggtagaagagctcaaacaacagtttgaaggaaagacggttttacttggggttgatgatatggacatctttaaaggtgttaatttgaagcttttggcaatggagcagctgctgaaacagcacccaaagtggcaacgaagggctgttttggtgcagataactaatcctgccaggggacgagggagagatcttgaggaagtgcaagctgaaatacaggaaagctgcaggagaattaatgagacttttggtcgacctggctatgaaccagttgtctttattgatcgaccagtatctctcagtgaaagatctgcatatttcaccattgctgagtgtgttgttgtggcagctgtgagagatgggatgaatctcactccttatgagtatattgtgtgcagacagggagtttctgggtcagagtctagctcaggatcaagtggccccaagaagagcatgctggttgtatcagagttcattggatgttccccttcactcagtggtgcaattcgagtcaatccatggaacattgaagcaaccgcagaagcaatgaatgaggcaatttcaatggcagattccgagaaacaattgcgccatgaaaagcactacaggtatgtcagcacgcatgatgtggcatattggtcaaggagtttctatcaagatatggagcggacttgcaaagaccatttcagaaggcgctgctggggaattggcttgagctttggtttcagagttgtggcgcttgatcctaatttcaaaaaattaaatatagatcaaattgaatctgcatatataaagtccaaaaacagagctatactcttggactatgatggaactgtaatgcctcaaaccaccatcaataagaccccaaaccaagaggtcatttcaatcataaatactctttgtagtgatgtcaagaacaccgtctttgttgtcagtggaaggggaagggatagtttagggaagtggtttgctcattgcaagaaacttggaattgctgctgagcatgggtacttcatgaggtggtctgtggatgaggactgggagaactgcgggcagagtagtgattttggatggactcaaatagctgaacctgttatgaatctgtacacagaagccactgatggatcttccatcgagacgaaagagagcgctttggtttggcaccacagagatgcagatccaggttttggagctgctcaggccaaggaattgttggaccatcttgagagcgtgcttgcaaatgagcctgttgcagtcaaaagtggtcaatgcattgtggaagttaagccccagggaattagtaaaggttctgtggcagaaaagatctttacatcaatggctgaaagtggaagacaggctgattttgtattgtgtattggggatgacagatcagatgaggatatgtttgaaagcattgataatgcaatagcgaacggtatcctaacctcaagcaaatctgtcttcgcttgcactgttggtcagaaaccaagcaaagccaagtattatttggatgacacaactgatgtcataaacatgctcgaagctcttgcagaagcttccgacccttcaccctctgcaggaagctccccctga

SEQ ID NO: 425 - protein, 853 aa, Populus tremuloides
MMSRSYTNLLDLASGNFPAMGQPRERKRLPRVMTVPGVISELDDDVANSVTSDVPSSVVQDRIIIVGNQLPVKAKRRPDNKGWSFSWDEDSLLLQLKDGLPEEMEVLYVGSLRADIDLSEQEDVSQILLDRFKCVPAFLPPDILSKFYHGFCKQYLWPLFHYMLPISGNHGGRFDRSLWEAYVAANKIFSQRVIEVINPEDDYVWIHDYHLMVLPTFLRRRFNRLRMGFFLHSPFPSSEIYRTLPVREEILKALLNSDLIGFHTFDYARHFLSCCSRMLGLEYQSKRGYIGLEYYGRTVGIKIMPVGIHMGQIQSVLKLADKDWRVEELKQQFEGKTVLLGVDDMDIFKGVNLKLLAMEQLLKQHPKWQRRAVLVQITNPARGRGRDLEEVQAEIQESCRRINETFGRPGYEPVVFIDRPVSLSERSAYFTIAECVVVAAVRDGMNLTPYEYIVCRQGVSGSESSSGSSGPKKSMLVVSEFIGCSPSLSGAIRVNPWNIEATAEAMNEAISMADSEKQLRHEKHYRYVSTHDVAYWSRSFYQDMERTCKDHFRRRCWGIGLSFGFRVVALDPNFKKLNIDQIESAYIKSKNRAILLDYDGTVMPQTTINKTPNQEVISIINTLCSDVKNTVFVVSGRGRDSLGKWFAHCKKLGIAAEHGYFMRWSVDEDWENCGQSSDFGWTQIAEPVMNLYTEATDGSSIETKESALVWHHRDADPGFGAAQAKELLDHLESVLANEPVAVKSGQCIVEVKPQGISKGSVAEKIFTSMAESGRQADFVLCIGDDRSDEDMFESIDNAIANGILTSSKSVFACTVGQKPSKAKYYLDDTTDVINMLEALAEASDPSPSAGSSP

SEQ ID NO: 426 - DNA, 2586 bp, Populus tremuloides
atggtttcaagatcatattccaacctcttagatcttgcttctggtgatgctccaaattttggtcgtgagaggaagaggcttcctcgagtggcaactgttgctgggatactgactgatctagatgatgaaaacagtgttagctctgatgccccctcttctgtctctcaagaacggatgattattgtgggaaaccagcttccccttcgggcacatcgaagtccagatggcagtggagggtggtgctttagctgggatgaggactcacttctcttacaactcaaagatggccttggagaagatgttgaagttatctatgttggttctcttaaagaagagattgcacctagtgagcaagatgatgtagcccaaacattgctcgaaacttttaaatgtgtcccggcatttatccctcctgaccttttttctaaattctatcatggattctgtaaacaacatctgtggcctttatttcactacatgctccctttatcaccagatcttggtggccggtttgacaggtccctttggcaagcctatgtttctgttaacaaaatatttgcagacaaagttatggaagtgattagtcctgacgatgattatgtgtgggttcatgactaccatttgatggttttgccaacatttttgaggaagagatttaatagggtgaagcttggtttcttcctccacagtccattcccatcttctgaaatatataggacacttcctgtaagggatgaacttttgagagcacttctcaactctgacctcattggttttcatacctttgattatgcaaggcacttcctctcttgttgcagtagaatgctcggtctttcttatcaatctaagcgaggttacatagggcttgagtattatggtcggacagtcagcatcaagattctccctgttgggattcacattggtcagcttcaatctgtgcttaatcttcccgagacagaatctaaggttacagagctacatgatcggtttaggggtcaaactgttatgctaggggttgatgacatggacatcttcaaaggaatcagcctgaaacttttggccatggaacagttgctcacccaacatcctaataagaggggtgaagttgttttggttcaaattgcaaacccagcaaggggccgaggaagggatgtacaggaggtccaatctgaaaccaaggctgcagtgaggaggattaatgagacatttggaagtccaggatacactccagtggttttgattgacagcccgctacagttttatgagcgcattgcttattacacaattgcagagtgttgtcttgttacagcggtgagggatgggatgaatctgataccctatgaatatattatatgtcgacaaggaaatgagaagctggatgagacattaggattaaacccatcagccccaagaaagagcatgctggttgtttcagagtttattggatgctccccatcactaagtggggcaattcgagtaaatccatggaatattgatgctgtaactgaagccatgaattctgccctgatagtcccggagcctgaaaaacagatgcgacacgagaagcaccataggtatgtgagtacgcatgatgttgcatattgggctcatagttttttgcaggatcttgaaagggcatgtagggatcatgtgaggaggaggtgctggggaattggttttggtttaggttttcgagtcattgccttggatccaaatttcagaaaactttcagttgaacatattgtttctgcctataagaggaccaaaaaccgggctattctattggattacgatggtactatgatactgccaagttcaattagtaggactccaaacatggaggctgttggagtcttgaacagcttgtgtacagaccccaagaatgttgttttccttgttagtgggaaagacagggaaactcttactgaatggttttcttcttgtgaaaagcttggaattgctgcagagcatggttattttatgaggaccaatcatgatgtggaatgggaaacatgtgtgtctgtaccagattttgattggaaatgtatcgctgatccagtaatgaaactatacactgaaacaactgatggttcttccattgaaacaaaagagagtgcacttgtttggaattaccagtatgcagatccagattttggttcgtgccaggctaaggagcttctagatcatctggaaagtgttcttgccaatgaaccagttactgtcaagagcggtcaacacattgtagaggttaaacctcagggggtcaacaaaggtctggtggccgaacgcctcctagaaataatgaaacagaagggaatgcttcccgattttgttctctgcattggggatgaccggtctgatgaggacatgtttgaggtgataatgagtgcaagatctggcccctctctttccccagttgctgaagtgtttgcatgcactgttggccgaaaacccagcaaggccaagtactatttggaagacacatccgagattttgagaatgctgcaaggtcttgccagtgcttcggagcaggttgctagaagtgccccccaatcctctcagcaagtgattattgacagagagtaa

SEQ ID NO: 427 - protein, 861 aa, Populus tremuloides
MVSRSYSNLLDLASGDAPNFGRERKRLPRVATVAGILTDLDDENSVSSDAPSSVSQERMIIVGNQLPLRAHRSPDGSGGWCFSWDEDSLLLQLKDGLGEDVEVIYVGSLKEEIAPSEQDDVAQTLLETFKCVPAFIPPDLFSKFYHGFCKQHLWPLFHYMLPLSPDLGGRFDRSLWQAYVSVNKIFADKVMEVISPDDDYVWVHDYHLMVLPTFLRKRFNRVKLGFFLHSPFPSSEIYRTLPVRDELLRALLNSDLIGFHTFDYARHFLSCCSRMLGLSYQSKRGYIGLEYYGRTVSIKILPVGIHIGQLQSVLNLPETESKVTELHDRFRGQTVMLGVDDMDIFKGISLKLLAMEQLLTQHPNKRGEVVLVQIANPARGRGRDVQEVQSETKAAVRRINETFGSPGYTPVVLIDSPLQFYERIAYYTIAECCLVTAVRDGMNLIPYEYIICRQGNEKLDETLGLNPSAPRKSMLVVSEFIGCSPSLSGAIRVNPWNIDAVTEAMNSALIVPEPEKQMRHEKHHRYVSTHDVAYWAHSFLQDLERACRDHVRRRCWGIGFGLGFRVIALDPNFRKLSVEHIVSAYKRTKNRAILLDYDGTMILPSSISRTPNMEAVGVLNSLCTDPKNVVFLVSGKDRETLTEWFSSCEKLGIAAEHGYFMRTNHDVEWETCVSVPDFDWKCIADPVMKLYTETTDGSSIETKESALVWNYQYADPDFGSCQAKELLDHLESVLANEPVTVKSGQHIVEVKPQGVNKGLVAERLLEIMKQKGMLPDFVLCIGDDRSDEDMFEVIMSARSGPSLSPVAEVFACTVGRKPSKAKYYLEDTSEILRMLQGLASASEQVARSAPQSSQQVIIDRE

SEQ ID NO: 428 - DNA, 2574 bp, Populus tremuloides
atggtgtcaagttcttgcataagtttattggacttggcatctgggaatatgatgaatttcagtcaggctcctagagctcttccaaggataatgactgttccaggaataatttctgacatagatggagatggaactaatgatggcaattctgatgctccatcaactgttaaaaagattatagtgtcaaattttctccctctgaatgctcagaaggatttaaaatctggcaaatggtcattcagtttcgatgaggactcccttctgttacaaatgaaagatggcttctcagaaaataccgaggttgtttatgtgggatctctaagggttgatgttgatactagtgagcaagaagaagtttctcaacaattgctggaggaatttaactgtgtacccacatttattccttctgaaatttataaaaacttttaccatggtttctgtaagcatcatctgtggccccttttccattacatgctgcctatgtgtccagatcatggtaatcgctttgatagattgctgtggcagtcgtatgtctctactaataaaatatttgcagataaagtcatgggagtgattaattcagaagaagattatgtttgggtccatgattatcacctaatggttctccctacttttttgaggaaacgttttaatcgaattaagcttggcttcttcctgcatagcccattcccctcgtcagaaatttaccggactctgcctgttagagatgaaattctgaaagcactgctgaatgcagatttgattggttttcatacattcgattatgctcgccattttctatcctgttgcagccggatgttgggcctatactacgaatccaaacgtggtcatattggtctggagtattttggccgcacagtgtacatcaaaattttgcctgtggggattcatatgggtcgagttgaatctgctttaaatcacccctcttcttccatcaaggtcaaagaaatccaaaaacagttcaaggggaaaaggcttgttgttggagttgatgatatggacatattcaagggcattagtctgaaattattagctatggagcatcttttgcagcagaattcagggatgcggggaaagctagtcttggttcaaattgttaatcctgctaggagctcagggaaagctgtacaagaagcaaaaatggagacacatacaattaccaaaaggataaatgatacttttggttttccaggctatgaaccagtggtcctgattgatcgtcatgtccccttttgtgagaaaactgcctactttgcattggctgaatgctgcattgtaaatgcagtgagagatggaatgaacctgatcccatacaagtacattgcgtgcaggcagggtacgccgaagatggacgaagctttaggagttgcctctgggtcgcgtcatacaagttcacttgttgtatcagagtttactggttgctcaccatcattaagtggagcgataagagtgaacccatgggacattgaagctgttgccaacgcattgaatgtggccatcaccatgcctgatttagagaagcagttgcggcatgaaaagcactatcgctttgttagctcccatgatgtagcttactgggcccgcagttttatgcaggatttgacacgagcatgcgaagatcattatagtaaacgttgctggggcattggctttggtctgaatttcagaatcttgtcactctctcctagctttaggaagctttccaatgattacatcatctctgcatacaagagaacttctaaaagggcaatattcttggactatgatggaacagtggtggctcaaacttccattcctaaaacccccagtcctgaagtcatctctgttctaaacaatctttgttctgatcccaggaacaatgtgtttatagttagtggcagaggaaaaaagtctctgagtgattggtttgctcaatgtgaaaatctgggtatagcagctgaacatggatacttcttgaggtggagtgggatgtctgattgggaaacgagatccttcgctgctgattttgattggaaaaacattgccgaacctgtcatgaaattgtatacagaggccactgatggttcctatatagagaccaaggagagtgccttggtatggcaccaccaagatgccgatccagattttggatcttgccaggcaaaggaactgttggatcatctggaaaatgtccttgcaaatgatccggtagttgttaagaggggccagaatattgttgaagtaaaaccacagggagtaactaaagggtttgttgcagagaaggttctttcctcgatgattgctaatgggaaacccccagatttcgtgttgtgcattggggatgacagatctgatgaagacatgtttgaaagcatgtcaaacacagcttatggttcgtcactcccttcagctccagcgatttttgcatgcactgttggccaaaagccaagcaaagctagatactatctagatgatactgttgatgtattagctttgcttcaatgcttggctgatgcttcaaattcaaagtcaagtagcacagaaacacaagtttctttcgataatgttgtctga

SEQ ID NO: 429 - protein, 857 aa, Populus tremuloides
MVSSSCISLLDLASGNMMNFSQAPRALPRIMTVPGIISDIDGDGTNDGNSDAPSTVKKIIVSNFLPLNAQKDLKSGKWSFSFDEDSLLLQMKDGFSENTEVVYVGSLRVDVDTSEQEEVSQQLLEEFNCVPTFIPSEIYKNFYHGFCKHHLWPLFHYMLPMCPDHGNRFDRLLWQSYVSTNKIFADKVMGVINSEEDYVWVHDYHLMVLPTFLRKRFNRIKLGFFLHSPFPSSEIYRTLPVRDEILKALLNADLIGFHTFDYARHFLSCCSRMLGLYYESKRGHIGLEYFGRTVYIKILPVGIHMGRVESALNHPSSSIKVKEIQKQFKGKRLVVGVDDMDIFKGISLKLLAMEHLLQQNSGMRGKLVLVQIVNPARSSGKAVQEAKMETHTITKRINDTFGFPGYEPVVLIDRHVPFCEKTAYFALAECCIVNAVRDGMNLIPYKYIACRQGTPKMDEALGVASGSRHTSSLVVSEFTGCSPSLSGAIRVNPWDIEAVANALNVAITMPDLEKQLRHEKHYRFVSSHDVAYWARSFMQDLTRACEDHYSKRCWGIGFGLNFRILSLSPSFRKLSNDYIISAYKRTSKRAIFLDYDGTVVAQTSIPKTPSPEVISVLNNLCSDPRNNVFIVSGRGKKSLSDWFAQCENLGIAAEHGYFLRWSGMSDWETRSFAADFDWKNIAEPVMKLYTEATDGSYIETKESALVWHHQDADPDFGSCQAKELLDHLENVLANDPVVVKRGQNIVEVKPQGVTKGFVAEKVLSSMIANGKPPDFVLCIGDDRSDEDMFESMSNTAYGSSLPSAPAIFACTVGQKPSKARYYLDDTVDVLALLQCLADASNSKSSSTETQVSFDNVV

SEQ ID NO: 430 - DNA, 2631 bp, Solanum lycopersicum
atgttgtcaagatcttgtttcaatctgcttaatcttgatgactgttctgttactgatcgggctcgaatcccaaagttgatgaatgttccagggattataacagattttggtggaggaggaggagaagaagagaagggggaagtttcacctggtgtgaaaaatgggagtagaaggatcattgtagcaaatcagttaccagtgaaagctttttgtaaagatgaaaaagaggggaaaaaatggtgttttgaatgggacagatatgctttagatacattgattttgcagctgaaagatggtttgtcaccagatttggagattgtttatgttggttgtttaaaagctgatgttgaattgaatgatcaagaagaagttgctaatttcttatgggagaaatttaggtgtgtaccaactttcttgtcattagatttgataaacaagtattaccatggcttttgtaagcattatttatggcctttgtttcattacatgttgcctttaacatctagtcatggtgtaagatttgataggtctaattggttggcttatgtatcagcaaacaagatttttgctgataaagtttatgaggtgattaatcctgatgatgattatgtttggattcaagattatcatcttatgattttgcctactatgttgaggaaaaagtatagtaggataaaagttgggtttttccttcatagtcctttcccgtcgtctgaaatttatcgaacattgcctgttagggatgagattttaagggctttgttgaattgcgatcttgttggttttcagacatttgattatgctagacatttcttgtcatgttgtagtaggatgttaggtttggattatcagtcaaaaaggggctacattggtatcgactattttggtagaactgtgactattaaaatccttcctgttggtattcacatggggcagatccaaaatgttatgtctttgcctgatacagcgaaaaaggcgaaggaattgaaagagaagtatgaggggaaaattgtgttgttaggtatcgatgatatggatgtgtttaaagggattggtctgaagtttttagcgatgggacatcttcttgagcaatcaccgtcgttgaggggaagggtagtgttggttcagattacgaaccctccgagaagtagaggaaatgatatcagagaggttgaagaagaggtcaagaagattgccagtgagatcaatacgaaatatggtaaaccggggtatgaaccgattgtctgtattaacggtccagtttctacgcaggacaagatagctcactatgcgatttctgagtgtgttgttgttaatgctgttagagatggaatgaatttggtgccttatgagtatacagtctctagggagagcaacagtaatttggataaggccttgggtccaggttttaatggaggacgacgaaagagtatgattgttgtttctgagttcatcggctgctcgccgtctctcagcggtgccatcagggtcaatccatgggacattgagagtgtagccactggtatgacttcaggagccatgatgaatgatagggagaaagaattgcgtcatgagaagcactatagatatgtttcttctcatgacgttgcatattgggcgaggagttttgatcaagatctcaagagagcttgtgaagatcattatcacaagagatgttggggtattggccttggtcttggcttcagggttgttgcgcttgggccgaatttcaagaagctttcggtagcccatatcgtctcttcttataaattgacaaacagcaggctcatcctactcgactatgatggtactatgttaccagaggataaagtggacaaagccccaagtcaagaagtcatctcagttctgaatggtttatgcagtgatccaaagaacatcgtgtttatcgtgagcggcaggggaagggatacgctcagcaagtggttttctccgtgtgcagaacttggcttatcagcagagcatggttacttcactaggtggaggaaggattccgattgggaatctcgtctggtacctgcagacactgagtggaaaaaagtggtcttgcctattatgaagaaatacaccgaggcaacagatggttcttcgatagagcagaaggaaagtgcactagtgtggcatcatcttgaagctgatcctgactttggcatttggcaggctaaagagcttcttgatcatctcgagagtgtgctcgctaacgagcctgtggttgttaaacgaggccagcacattgttgaggtgaaaccacaggatgtaagcaaaggtctggtgtttcaaagcctcttggcatcgatgaaaagcaaagggaagtcacccgatttcgtgttgtgcataggtgatgacagatcagatgaagacatgtttgagagcattgcaagttctttagacaacagttctctgcctgataatgcagaagtctttgcctgcaccgtcgggcagaaaccgagtatggctaagtactatcttgatgatccagctgaagttataaaaatgcttcaaggcctttcagcagcttctacagcaatgcagctaccacctaagtcaccggtccatcaactcgcctctgtcgaagatctctccctagttaagaatcatgcatcctttgtatag

SEQ ID NO: 431 - protein, 876 aa, Solanum lycopersicum
MLSRSCFNLLNLDDCSVTDRARIPKLMNVPGIITDFGGGGGEEEKGEVSPGVKNGSRRIIVANQLPVKAFCKDEKEGKKWCFEWDRYALDTLILQLKDGLSPDLEIVYVGCLKADVELNDQEEVANFLWEKFRCVPTFLSLDLINKYYHGFCKHYLWPLFHYMLPLTSSHGVRFDRSNWLAYVSANKIFADKVYEVINPDDDYVWIQDYHLMILPTMLRKKYSRIKVGFFLHSPFPSSEIYRTLPVRDEILRALLNCDLVGFQTFDYARHFLSCCSRMLGLDYQSKRGYIGIDYFGRTVTIKILPVGIHMGQIQNVMSLPDTAKKAKELKEKYEGKIVLLGIDDMDVFKGIGLKFLAMGHLLEQSPSLRGRVVLVQITNPPRSRGNDIREVEEEVKKIASEINTKYGKPGYEPIVCINGPVSTQDKIAHYAISECVVVNAVRDGMNLVPYEYTVSRESNSNLDKALGPGFNGGRRKSMIVVSEFIGCSPSLSGAIRVNPWDIESVATGMTSGAMMNDREKELRHEKHYRYVSSHDVAYWARSFDQDLKRACEDHYHKRCWGIGLGLGFRVVALGPNFKKLSVAHIVSSYKLTNSRLILLDYDGTMLPEDKVDKAPSQEVISVLNGLCSDPKNIVFIVSGRGRDTLSKWFSPCAELGLSAEHGYFTRWRKDSDWESRLVPADTEWKKVVLPIMKKYTEATDGSSIEQKESALVWHHLEADPDFGIWQAKELLDHLESVLANEPVVVKRGQHIVEVKPQDVSKGLVFQSLLASMKSKGKSPDFVLCIGDDRSDEDMFESIASSLDNSSLPDNAEVFACTVGQKPSMAKYYLDDPAEVIKMLQGLSAASTAMQLPPKSPVHQLASVEDLSLVKNHASFV

SEQ ID NO: 432 - DNA, 2613 bp, Zostera marina
atgatgtcaagatcgtacacaaatcttctggatctagcgtcggggaacttcccggtgattagtggcggtggacgggatggtcgtagcggtgggatgcgacgaatgccgcgagtgatgactgttccgtcaaacatagcggagcttgaggatgaacaagcgagtagtgttgcttcggatgtgcagtcttctattattcaagatcggttaataatagtcggtaaccaacttcctgttgtcgccaaacgccgatcagataacgccggttgggatttctcttgggatgatgagtctctccttcttcaactcaaagacggcttaccggatgatatggaagtcttatacgtcggttgcctccgtgtcatcgtcgatcctgaagaacaagacgacgtctcccaaacactacttgagaagttcaaatgcgtgccggcatttctaactgaggaaatccttgaaaagtactatcacggcttctgcaagaagctactgtggccgttgtttcattacatgttgccattgacgaaagatcatggtggaaggtttgataggtctctttgggaggcttatgttgcggtgaacaagatattttcacagaaggttgttgaaattattagtccagaagatgactatgtttggattcatgattaccatctcatggttcttccaactttgcttagacgaaggtttattcggcttcgaatgggtttttttcttcacagcccgttcccatcatcagagatttatagaacacttcccgtacgtgaagagattctaaattcgctactatgttccgatttgattggattccacacatttgattatgcacggcatttcttgtcatgttgtagtagaatgatggggttggaataccaatcaaaacgagggtatatcagtttagattactttggccgaacggttggaatcaagatcatgcccgccagtattcatttgggccagttggagtctatgttgaagactgtgtataaggagtcgaagattgaggaacttgagaggcagtttcaggggaagactgtcattttaggagttgatgatatggatatctttaaggggattaatttgaaattattggccttcgaacagatgctgaagcttcgtcctaattggcagggaagggctgtgctggttcagatcgccaatcctgcaagagggagaggaaagggacttgaaagtgtggaggttgagattcgagatatttgtgaaaggatcaatcaacagtttggacgtgttggttacaaacctgtagtgtacatcaatcgatctgtttcattgaaagaaaggattgcctattacacaatcgcagaatgtgttgttgtttccgcagtgagggatgggatgaatctaataccatatgagtacactgtctgtaagcaaggaatcgccgagcctgaatcagattcattatttgctgatccaaaaaaaagtatgttggtcgtgtcagaattcattggttgttctccttctttgagtggtgcaatcaagattaatccttggaacagcgaagcgactgcagaggctatgagtgatgcaatctcgatgcccgatggagagaagcaattgcgtcatgggaagcattatagatatgttcggactcatggtgtttcatattggtcaaaaagtttcatgcaggatatggagaggacatgcaaggatcattttaagaggagatgttggggtattggattcgggtttggttttagagttgttgccctcgatcctaatttcaaaaaactcaatgtggactccattgtgttttcatatgaaagggccaaaagtagggctatattattggattatgatggaacgatgattaatccattatctattaacaaaacaccgagcactgaagtgatctctattttgaacgctcttagtaaagacaaaaagaatgttgtttttatggtgagtggcaggggaagggagagtttagggagttggttttcttcatgcgagaagcttggaattgcagcagagcatggttttttcatgaggtgggggcgagatgatgaatggacgacttgggacaaaaataaagattttgggtggatgttgatggcggatcctgtaatgaaattatacacagaggctacagatggatcatatattgaagccaaagaaagtgccttggtttggcaccaccgagatgccgatcaaacttttggaacctctcaagcaaaagagatgttagaccatctcgaaaacgttttggctaacgaacctgttatcgcaaagcgtggccaattcattgttgaagttaagccacagggagttagcaaaggtttagtagcagataacattttatcaacaatggctaagagaaactgcccagcagattttgtattgtgtattggtgatgatagatcagatgaagacatgtttgaaaactttggtagcaagaatttggtatcctttaatgcacatatatattcctgcacggttgggcaaaaacctagcaaagccacttattatttagatgacactaatgatgttttggaaatgcttcgtgcccttgctgatgcctccgaagaagatgatgacgatgaagaggaaatcgaagatgattatgttgatgatgaatcggaagaaggttcaagttaa

SEQ ID NO: 433 - protein, 870 aa, Zostera marina
MMSRSYTNLLDLASGNFPVISGGGRDGRSGGMRRMPRVMTVPSNIAELEDEQASSVASDVQSSIIQDRLIIVGNQLPVVAKRRSDNAGWDFSWDDESLLLQLKDGLPDDMEVLYVGCLRVIVDPEEQDDVSQTLLEKFKCVPAFLTEEILEKYYHGFCKKLLWPLFHYMLPLTKDHGGRFDRSLWEAYVAVNKIFSQKVVEIISPEDDYVWIHDYHLMVLPTLLRRRFIRLRMGFFLHSPFPSSEIYRTLPVREEILNSLLCSDLIGFHTFDYARHFLSCCSRMMGLEYQSKRGYISLDYFGRTVGIKIMPASIHLGQLESMLKTVYKESKIEELERQFQGKTVILGVDDMDIFKGINLKLLAFEQMLKLRPNWQGRAVLVQIANPARGRGKGLESVEVEIRDICERINQQFGRVGYKPVVYINRSVSLKERIAYYTIAECVVVSAVRDGMNLIPYEYTVCKQGIAEPESDSLFADPKKSMLVVSEFIGCSPSLSGAIKINPWNSEATAEAMSDAISMPDGEKQLRHGKHYRYVRTHGVSYWSKSFMQDMERTCKDHFKRRCWGIGFGFGFRVVALDPNFKKLNVDSIVFSYERAKSRAILLDYDGTMINPLSINKTPSTEVISILNALSKDKKNVVFMVSGRGRESLGSWFSSCEKLGIAAEHGFFMRWGRDDEWTTWDKNKDFGWMLMADPVMKLYTEATDGSYIEAKESALVWHHRDADQTFGTSQAKEMLDHLENVLANEPVIAKRGQFIVEVKPQGVSKGLVADNILSTMAKRNCPADFVLCIGDDRSDEDMFENFGSKNLVSFNAHIYSCTVGQKPSKATYYLDDTNDVLEMLRALADASEEDDDDEEEIEDDYVDDESEEGSS

SEQ ID NO: 434 - DNA, 2598 bp, Zea mays
atggtttcaaaatcatactcaaatctgctagacctgacctctggagatggatttgactttcgacaaccttttaagtctcttcctcgtgtcgtaacttctcctggtattatatctgacactgattgggatacaataagtgatggtgattcagttggttcagcatcttctactgagaggaaaataatcgttgccaacttccttccgttgaattgtacaagagatgaaactggggtgctttccttctcattggatcatgatgcgcttctcatgcaacttaaagatagtttttcaaatgagactgatgttgtgtatgtgggcagtttgaaggttcaggtagatcctggtgagcaggaccaagttgcacagaagcttcttagagaatatcgatgcatacctacttttctcccatctgacctacagcagcagttctatcatggcttctgtaaacaacaattatggccactttttcattatatgcttccaatttgccttgacaagggtgagctatttgatcgcagcctgtttcaagcttatgtccgagccaacaaactttttgcagataaagttatggaagcaatcaatgcagatgatgacttcgtttgggttcatgattatcatctcatgttgctccctacattcttgaggaagaggttacaccgaataaagattggtttcttccttcacagtccttttccctcctcagaaatctataggactctgcctgtaagggatgaaatcctgaagtcactgcttaatgctgatctcattggtttccaaacatttgactatgcccgccacttcctatcttgctgtagcagattgctaggcctgcattatgagtcaaaacgtggttacattggaatagagtattttggccgaacagtgagcctgaagatcctttccgtgggtgtccatattggtcggcttgaatctgtcttaaaattgcctgctacagttagtaaggttcaagaaattgaacaaaggtataagggcaagatactgatgttaggtgtagatgacatggacatcttcaaagggataagtctgaaatttcttggactggagcttcttctggacagaaacccaaagcttagagagaaggttgtccttgtacaaatcatcaatccagcaagaagcacagggaaggacgtgcaagaagctattacagaagctgtctctgtggctgaaaggattaatacaaattatggttcttcaagttacaagcctgttgtcctaattgatcaccacataccattttatgaaaagattgcattctatgctgcgtctgattgctgtattgtaaatgctgtgagggatggcatgaacttagtaccatatgagtatactgtttgccgacagggaaatgaggagattgataaactcagaggtcttggcaaagacacccatcacacaagcacacttattgtttcggagtttgtgggttgctccccatctcttagtggtgctttcagggtaaatccttggagtgtcgatgatgtggcggatgccttgtgccgtgcaactgatttgactgaatccgagaaacggctgcggcatgaaaagcattatcgctatgtcagtactcatgatgttgcttactgggcacgcagctttgctcaagatctggaaagagcatgcaaagatcattatagcagaaggtgttgggcgattggattcggtctgaattttagagttattgctctttctcctggcttcagaaagctgtcgtcagagcactttgtttcttcttataacaaggcttctagaagagcaatatttcttgattacgatggcacacttgtgccccagtcatcaatcaacaaagctccaagtgaagaagtcatttccgttcttaacaccttatgtaatgatccaaagaacattgtgtttatagtaagtggacgaggacgtgattcccttgatgagtggttttctccgtgtgagaagcttggtctagcggcagaacatggctattttatcagatggagcaaggaagccgcatgggagtcaagctattcaaggccgcagcaagaatggaagcacattgccgaacctgtgatgcaggtatacacagagacaacagatggatcttcaatcgagtcaaaggaaagcgccctagtatggcactatttggacgcggaccatgatttcggttccttccaagcaaaggagctacaaggtcatcttgagagggtgctatcgaatgagcctgttgttgtgaagtgtggtcattatattgtagaggtgaaaccacagggagttagcaaggggcttgctgtcaacaagctgattcacacactggtcaagaacgggaaggcaccggatttcctgatgtgcgtcggcaacgacagatctgatgaggacatgtttgaaagcatcaacggtatgacctccaacgctgtcttatcacccacaatgccggagctgtttgcctgttcagtcggtcagaagcccagcaaagcaaaatattatgtggacgacaccagcgaagtaatcagattgctcaagaatgtaacccgcatcccctcgcagcggcaggatgtcagtgccagccatgggcgtgtgaccttcagaggcgtgctcgattacgtggactag

SEQ ID NO: 435 - protein, 865 aa, Zea mays
MVSKSYSNLLDLTSGDGFDFRQPFKSLPRVVTSPGIISDTDWDTISDGDSVGSASSTERKIIVANFLPLNCTRDETGVLSFSLDHDALLMQLKDSFSNETDVVYVGSLKVQVDPGEQDQVAQKLLREYRCIPTFLPSDLQQQFYHGFCKQQLWPLFHYMLPICLDKGELFDRSLFQAYVRANKLFADKVMEAINADDDFVWVHDYHLMLLPTFLRKRLHRIKIGFFLHSPFPSSEIYRTLPVRDEILKSLLNADLIGFQTFDYARHFLSCCSRLLGLHYESKRGYIGIEYFGRTVSLKILSVGVHIGRLESVLKLPATVSKVQEIEQRYKGKILMLGVDDMDIFKGISLKFLGLELLLDRNPKLREKVVLVQIINPARSTGKDVQEAITEAVSVAERINTNYGSSSYKPVVLIDHHIPFYEKIAFYAASDCCIVNAVRDGMNLVPYEYTVCRQGNEEIDKLRGLGKDTHHTSTLIVSEFVGCSPSLSGAFRVNPWSVDDVADALCRATDLTESEKRLRHEKHYRYVSTHDVAYWARSFAQDLERACKDHYSRRCWAIGFGLNFRVIALSPGFRKLSSEHFVSSYNKASRRAIFLDYDGTLVPQSSINKAPSEEVISVLNTLCNDPKNIVFIVSGRGRDSLDEWFSPCEKLGLAAEHGYFIRWSKEAAWESSYSRPQQEWKHIAEPVMQVYTETTDGSSIESKESALVWHYLDADHDFGSFQAKELQGHLERVLSNEPVVVKCGHYIVEVKPQGVSKGLAVNKLIHTLVKNGKAPDFLMCVGNDRSDEDMFESINGMTSNAVLSPTMPELFACSVGQKPSKAKYYVDDTSEVIRLLKNVTRIPSQRQDVSASHGRVTFRGVLDYVD

SEQ ID NO: 436 - DNA, 2742 bp, Zea mays
atgatgtcgcggtcgtacaccaacctgctcgacctcgcggagggcaacttcgcggcgctgggcccggccgccggcgccggcggcagcgggcggcagaggcatgggtcgttcgggctgcggcggatgtcgcgggtgatgacggtgccggggacgctgacggagctcgacggcgaggacgagtcggagccggccgcgaccagcagcgtcgcctccgacgtgccctcgtccgtggcggcggaccgcctcatagtggtctcgaatcagttgcccatcgtcgcgcgccgcaggcccgacggccgagggtggtccttctcgtgggacgatgactcgctcctgctccagctccgcgacggcattcccgacgagatggaggtgctcttcgtcggatcactccgcgccgacgtccccgcagccgagcaggacgcggtatcgcaggcgctgctcgaccgattccgctgcgcgccggtgttcctccctgaccacctcaacgaccggttctaccacggcttctgcaagcgccagctctggcctctgttccactacatgctccccttctcatcgcccgcttccgcgtctgccgccgctacctcttcctccgtcgccacttcgtcacccggcaacggttgcttcgaccgcagcgcttgggaggcatacgtgctcgccaacaagttcttctttgagaaggtcgtcgaggtaatcaacccggaggatgactacgtctgggttcacgactaccatctcatggcgctgcctaccttcctccgccgctgcttcaaccgcctccgcatcggattcttcctccacagccccttcccctcgtccaagatctaccgcaccctccctgttcgggaggagatactcaaggcgctgctcaactgtgacctaattggcttccacacttttgattacgccaggcacttcctctcgtgctgcagtaggatgctgggaattgaataccagtcaaagcgtgggtacattgaattggattactttggccgcactgtcgggatcaaaatcatgccagtgggagttcatatgggtcaattggagttgggtctgcgcttgcctgatagggaatggaggctttctgagcttcaacgccagtttcaggggaaaactgtcttgcttggtgtggatgatatggatatctttaaggggatcaatttgaagcttctcgcctttgagaacatgttgaggacacatcccaagtggcaggggagagcagtgttagtgcagattgctaacccagcccgtggaaggggtaaagatctggaagccatccaggctgagattgaggagagctgccagcggatcaatggagactttggccagtcagggtatagccctgttgttttcatcgatcgtgatgtgtcaagtgttgagaagattgcctattatacgatagcggaatgtgtggtggtgactgctgtgagggatgggatgaacttgacaccgtatgaatacgttgtctgtaggcagggtgcaccaggatctcagtcggtagcagaggtgagtgggccaaagaagagcatgctggttgtgtcagagtttattggctgctcaccgtcactgagcggtgctattagggttaacccatggaatatagaggcaaccgcggaggcgatgaatgaggccatttcaatgccagaacaggaaaaacagttgaggcatgagaaacattaccgttatgtcaggagccatgacgtcgcttattggtcaaagagcttcatcatagacttggaaagggtttgtaaggatcacttcaagaggacttgttggggcatagggttgggttttggtttcagggtggtggccttggaccctcatttcacaaagcttaacatggattcaatcattaatgcttatgagctttcagagagcagggctatattgctcgattatgatggaactctggttccccaaacttccctcaacaaggaacctagtccacaggttttgagcatcatcaataccctttgctcagatagtagaaacatcgtttttcttgtcagtggtcgagacaaagataccttgggaaagtggttctcctcatgtccaagattggggattgcagctgaacatggttacttcttgaggtggtctagagaagaagagtggcaaacatgcactcaggcattggacttcggatggatgcaaatggcgaagccagtgatgaatttatatacagaagcaactgatggatcctacattgaggccaaggaaagtgccttggtgtggcaccatcaggatgctgacctaggctttggatcctcacaggcaaaggagatgcttgatcacctggaaagtgtactagcaaatgaaccagtctctgtcaagagtggccagttcattgttgaagtcaaaccacagggaataagcaaaggaatagttgctgagaggatacttgcatcagtgaaggagagaggaaagcaggctgatttcttattgtgcatcggcgatgataggtctgatgaggacatgtttgaaaatattgctgatatcactgggaggaatttggttgctccaagaacagcactgtttgcgtgcactgtgggacaaaaaccaagcaaagccaaattctatctggatgatacattcgaagtggtcactatgctgagcgcactggcagatgccacaggtcctgagactgattcggctgatgaatctgtcgcatatatctcatcacttgatattggtgacgaacaatcagaatccagtgataaaccagttgaagggtcttag

SEQ ID NO: 437 - protein, 913 aa, Zea mays
MMSRSYTNLLDLAEGNFAALGPAAGAGGSGRQRHGSFGLRRMSRVMTVPGTLTELDGEDESEPAATSSVASDVPSSVAADRLIVVSNQLPIVARRRPDGRGWSFSWDDDSLLLQLRDGIPDEMEVLFVGSLRADVPAAEQDAVSQALLDRFRCAPVFLPDHLNDRFYHGFCKRQLWPLFHYMLPFSSPASASAAATSSSVATSSPGNGCFDRSAWEAYVLANKFFFEKVVEVINPEDDYVWVHDYHLMALPTFLRRCFNRLRIGFFLHSPFPSSKIYRTLPVREEILKALLNCDLIGFHTFDYARHFLSCCSRMLGIEYQSKRGYIELDYFGRTVGIKIMPVGVHMGQLELGLRLPDREWRLSELQRQFQGKTVLLGVDDMDIFKGINLKLLAFENMLRTHPKWQGRAVLVQIANPARGRGKDLEAIQAEIEESCQRINGDFGQSGYSPVVFIDRDVSSVEKIAYYTIAECVVVTAVRDGMNLTPYEYVVCRQGAPGSQSVAEVSGPKKSMLVVSEFIGCSPSLSGAIRVNPWNIEATAEAMNEAISMPEQEKQLRHEKHYRYVRSHDVAYWSKSFIIDLERVCKDHFKRTCWGIGLGFGFRVVALDPHFTKLNMDSIINAYELSESRAILLDYDGTLVPQTSLNKEPSPQVLSIINTLCSDSRNIVFLVSGRDKDTLGKWFSSCPRLGIAAEHGYFLRWSREEEWQTCTQALDFGWMQMAKPVMNLYTEATDGSYIEAKESALVWHHQDADLGFGSSQAKEMLDHLESVLANEPVSVKSGQFIVEVKPQGISKGIVAERILASVKERGKQADFLLCIGDDRSDEDMFENIADITGRNLVAPRTALFACTVGQKPSKAKFYLDDTFEVVTMLSALADATGPETDSADESVAYISSLDIGDEQSESSDKPVEGS

SEQ ID NO: 438 - DNA, 2595 bp, Zea mays
atggttctgaagtcgcacacaaatctgctagatatgtgttgtgaagatgtgtttgacttccaacaacctttaagatctcctcgtcatgtggtgaactctcctggcatcatatctgaccctgattgggaaagtagtaatgatggcaactcagttggttctatgcctttttgttttaagagaaagattattgttgcaaatttccttcctgtgatctgtgcaaaaaatgaagctaccggagaatggtcctttgccatggatgataatcaactgcttgttcaactcaaagatggttttccaattggtaatgaagttatttatgtgggtagtttgaatgttcaagttgatcctattgagcaagatcgagtttctcagaagctcttcaaggaacacagatgcgtacctacctttctcccagctgaactccagcatcaattctatcacatattctgcaaacagcacttatggccacttttccattatatgcttcctgtttgtcatgacaaagatgagctctttgaccgttccctttttcaagcctacgtgcgggccaacaaaatttttgctgacaaaattgtggaggcagtcaattcggatgatgattgtgtgtgggttcatgattatcacctcatgcttatcccaacccttttaagaaagaaactgcaccggatcaaagttggtttcttcctccacagcccatttccctcgtctgagatctataggacactgccagtgcgggatgaaattctaaaatcacttcttaatgctgacctcattggctttcaaacttttgactatgcccgccacttcctttcatgttgcagcaggcttttaggccttaattatgagtccaaacgtggccacataggtatagagtacttcggccgaacagtgagcctcaagattcttgctgcaggtgtacatgttggccggcttgaggctacattgaggttgcctgctacaattaaaaaggttcaagaaattgagagtagatatagtggcaagttggtaatattaggtgtagatgacatggacatctttaaaggtatcagtctaaaactgcttggcttggagcttcttctggaaagaacacctaagcttcgaggcaaggttgtccttgtacagattgttaatcctgcaagaagcatcggaaaagacattgaggaagcgaaatatgaagctgaatctgtagctcaaaggataaatgataaatatggttctgctaattacaagcctgttgtcctcattgactactcaatacctttctatgaaaagatcgcattttatgctgcatctgactgctgtattgtaaatgctgtgagggatggcatgaatttgataccgtatgagtacaccgtatgcaggcagggaaatgaggagcttgataagctcagaggtcttaataagagctcatctcacacaagcacacttattgtgtctgaatttgtgggttgctctccatcacttagtggagcattcagggtaaatccttggagtatggaagatgtggctgatgcattatacagtgtaacagacctgacacgatatgagaagaatctgcgccatgaaaagcactatcgctatgtcaggtctcatgatgttgcttactgggcacgcagctttgaccaggatctggataaagcatgcatagagcaatacagccaaagatgttggacaactgggtttggtttaaattttagagttattgccctttcacctgggtttagaagactgtctctagaacacctagcctcgtcttataagaaggctaacaggaggatgatattcctggactacgatgggacccttgtgccgcagacatcacacgacaaatctccaagcgctgaacttatctctacccttaacagcttgtgcagtgatatgaagaacacagtatttatagtcagcggacgaggaagagattccctaagcgagtggtttgcttcatgcgagaacctcggtatcgctgccgaacatggttactttatcagatggaacaaagcagctgaatgggagacaagcttctcaggtatttattctgaatggaagctcatcgcggaccctatcatgcatgtatacatggaaacaactgatgggtccttcatagagccaaaagagagcgctttggtatggcactatcagaacacggatcatgactttggctcgtgccaggcaaaggagctagtgagccatcttgagcgagtcctatcgaacgaacctgttgtcgtgaggcgtggccatcagatcgtagaagttaaacctcagggagttagcaaggggatttccgtggacaagatcatccggaccttggtcagcaaaggggaagtaccagaccttttgatgtgcatcggaaacgatcggtcggacgaggacatgttcgagagcatcaacagagccacctccctttccgagcttcctgccgctccagaagtattcgcctgttccgttggccccaaggccagcaaggcaaactactacgtcgatggctgcgacgaagtaatcagactgctgaagggtgtcacagccgtttcgctccaaaaggatactgccggccatagccatgcggcattcgaggatacgcttgaggttgtcagctga

SEQ ID NO: 439 - protein, 864 aa, Zea mays
MVLKSHTNLLDMCCEDVFDFQQPLRSPRHVVNSPGIISDPDWESSNDGNSVGSMPFCFKRKIIVANFLPVICAKNEATGEWSFAMDDNQLLVQLKDGFPIGNEVIYVGSLNVQVDPIEQDRVSQKLFKEHRCVPTFLPAELQHQFYHIFCKQHLWPLFHYMLPVCHDKDELFDRSLFQAYVRANKIFADKIVEAVNSDDDCVWVHDYHLMLIPTLLRKKLHRIKVGFFLHSPFPSSEIYRTLPVRDEILKSLLNADLIGFQTFDYARHFLSCCSRLLGLNYESKRGHIGIEYFGRTVSLKILAAGVHVGRLEATLRLPATIKKVQEIESRYSGKLVILGVDDMDIFKGISLKLLGLELLLERTPKLRGKVVLVQIVNPARSIGKDIEEAKYEAESVAQRINDKYGSANYKPVVLIDYSIPFYEKIAFYAASDCCIVNAVRDGMNLIPYEYTVCRQGNEELDKLRGLNKSSSHTSTLIVSEFVGCSPSLSGAFRVNPWSMEDVADALYSVTDLTRYEKNLRHEKHYRYVRSHDVAYWARSFDQDLDKACIEQYSQRCWTTGFGLNFRVIALSPGFRRLSLEHLASSYKKANRRMIFLDYDGTLVPQTSHDKSPSAELISTLNSLCSDMKNTVFIVSGRGRDSLSEWFASCENLGIAAEHGYFIRWNKAAEWETSFSGIYSEWKLIADPIMHVYMETTDGSFIEPKESALVWHYQNTDHDFGSCQAKELVSHLERVLSNEPVVVRRGHQIVEVKPQGVSKGISVDKIIRTLVSKGEVPDLLMCIGNDRSDEDMFESINRATSLSELPAAPEVFACSVGPKASKANYYVDGCDEVIRLLKGVTAVSLQKDTAGHSHAAFEDTLEVVS

SEQ ID NO: 440 - DNA, 3755 bp, Arabidopsis thaliana
tttgtacaaaaaagcaggcttaaacaatggattataataggcaacgactacttgtagtggctaacaggctcccagtttctgccgtgagaagaggtgaagattcatggtctcttgagatcagtgctggtggtctagtcagtgctctcttaggtgtaaaggaatttgaggccagatggataggatgggctggagttaatgtgcctgatgaggttggacagaaggcacttagcaaagctttggctgagaagaggtgtattcccgtgttccttgatgaagagattgttcatcagtactataatggttactgcaacaatattctgtggcctctgtttcactaccttggacttccgcaagaagatcggcttgccacaaccagaagctttcagtcccaatttgctgcatacaagaaggcaaaccaaatgttcgctgatgttgtaaatgagcactatgaagagggagatgtcgtctggtgccatgactatcatcttatgttccttcctaaatgccttaaggagtacaacagtaagatgaaagttggatggtttctccatacaccattcccttcgtctgagatacacaggacacttccatcacgatcagagctccttcgctcagttcttgctgctgatttagttggcttccatacatatgactatgcaaggcactttgtgagtgcgtgcactcgtattcttggacttgaaggaacacctgagggagttgaggatcaaggcaggctcactcgtgtagctgcttttccaattggcatagattctgatcggtttatacgagcacttgaggtccccgaagtcatacaacacatgaaggaattgaaagaaagatttgctggcagaaaggtgatgttaggtgttgatcgtcttgacatgatcaaagggattccacaaaagattctggcattcgaaaaatttctcgaggaaaatgcaaactggcgtgataaagtggtcttattgcaaattgcggtgccaacaagaactgacgttcctgagtatcaaaaactcacaagccaagttcatgaaattgttggacgcattaatggtcgttttgggacactgactgcagttccaatacatcatctggatcggtctctggactttcatgctttatgtgcactttatgccgtcacagatgttgcgcttgtaacatctttgagagatgggatgaatcttgtcagttatgagtttgttgcttgccaagaggccaaaaagggcgtcctcattctcagtggatttgcaggtgctgcacagtctctgggtgctggagctattcttgtgaatccttggaacatcacagaagttgctgcctccattggacaagccctaaacatgacagctgaagaaagagagaaaagacatcgccataattttcatcatgtcaaaactcacactgctcaagaatgggctgaaacttttgtcagtgaactaaatgacactgtaattgaggcgcaactacgaattagtaaagtcccaccagagcttccacagcatgatgcaattcaacggtattcaaagtccaacaacaggcttctaatcctgggtttcaatgcaacattgactgaaccagtggataatcaagggagaagaggtgatcaaataaaggagatggatcttaatctacaccctgagcttaaagggcccttaaaggcattatgcagtgatccaagtacaaccatagttgttctgagcggaagcagcagaagtgttttggacaaaaactttggagagtatgacatgtggctggcagcagaaaatgggatgttcctaaggcttacgaatggagagtggatgactacaatgccagaacacttgaacatggaatgggttgatagcgtaaagcatgttttcaagtacttcactgagagaactcccaggtcacactttgaaactcgcgatacttcgcttatttggaactacaaatatgcagatatcgaattcgggagacttcaagcaagagatttgttacaacacttatggacaggtccaatctctaatgcatcagttgatgttgtccaaggaagccgctctgtggaagtccgtgcagttggtgtcacaaagggagctgcaattgatcgtattctaggagagatagtgcatagcaagtcgatgactacaccaatcgattacgtcttgtgcattggtcatttcttggggaaggacgaagatgtttacactttcttcgaaccagaacttccatccgacatgccagccattgcacgatccagaccatcatctgacagtggagccaagtcatcatcaggagaccgaagaccaccttcaaagtcgacacataacaacaacaaaagtggatcaaaatcctcatcatcctctaactctaacaacaacaacaagtcctcacagagatctcttcagtcagagagaaaaagtggatccaaccatagcttaggaaactcaagacgtccttcaccagagaagatctcatggaatgtgcttgacctcaaaggagagaactacttctcttgcgctgtgggtcgtactcgcaccaatgctagatatctccttggctcacctgacgacgtcgtttgcttccttgagaagctcgctgacaccacttcctcacctggccggccaatgactaaccagaatgtcatcgtttccgacaggaaacccatcttgggtttgaaaaccatcactgtctctgtctctaactctcctctgttctctaattcctttcccacttactttaacttccctcgtcgaaagctcttgaaacttcttgaagcagccgacaaaaacaacttagttgttgctccaaagattacgtctatgatcgattccatgcgtgattcttcccctacacgtctcagatcctcttcctatgactctgtttcagataacgacgacaaaacatcttggatcgttcgttttccttcggctttaaatatgtttgatgagattgtgaatgctgcgaaagggaaacagattgtcatgtttcttgattacgacggaactctttctcccatagttgaagatcccgacaaagctttcataacccatgagatgagagaagtcgtaaaagacgtggcttcgaatttcccgactgctattgtcaccgggagatccattgagaaggttcgtagttttgtccaagtaaacgagatttactacgccggaagccacggcatggacattgaaggtccgaccaacgaaaatagtaacggccagagtaatgaaagagtgctattccaacctgctcgtgaatttttaccgatgatcgagaaggtggttaatattttagaggaaaaaacaaaatggatccctggggctatggtggagaacaacaagttttgtctgtccgtacattttcgacgtgttgatgagaagagatggcctgcattagctgaagtagtaaaatcagttcttattgattatccaaagctgaaactaacccaaggtagaaaggtacttgaaatccgccccacaatcaaatgggacaagggccaggcactcaattttttactaaaatcattaggatatgaaaattcggatgatgttgtgccggtgtatatcggggatgaccgtactgacgaagatgcgtttaaggttctacgtgaaaggggacaaggttttgggattcttgtctcaaaagtaccaaaggacaccaatgcctcttattctcttcaagacccttctcaggttaacaagtttctggaacgtttagtagaatggaagaggaagacagtgggagaagagtgaggtaccacccagctttcttgtacaaag

SEQ ID NO: 441 - protein, 1233 aa, Arabidopsis thaliana
MDYNRQRLLVVANRLPVSAVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVIQHMKELKERFAGRKVMLGVDRLDMIKGIPQKILAFEKFLEENANWRDKVVLLQIAVPTRTDVPEYQKLTSQVHEIVGRINGRFGTLTAVPIHHLDRSLDFHALCALYAVTDVALVTSLRDGMNLVSYEFVACQEAKKGVLILSGFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSPGRPMTNQNVIVSDRKPILGLKTITVSVSNSPLFSNSFPTYFNFPRRKLLKLLEAADKNNLVVAPKITSMIDSMRDSSPTRLRSSSYDSVSDNDDKTSWIVRFPSALNMFDEIVNAAKGKQIVMFLDYDGTLSPIVEDPDKAFITHEMREVVKDVASNFPTAIVTGRSIEKVRSFVQVNEIYYAGSHGMDIEGPTNENSNGQSNERVLFQPAREFLPMIEKVVNILEEKTKWIPGAMVENNKFCLSVHFRRVDEKRWPALAEVVKSVLIDYPKLKLTQGRKVLEIRPTIKWDKGQALNFLLKSLGYENSDDVVPVYIGDDRTDEDAFKVLRERGQGFGILVSKVPKDTNASYSLQDPSQVNKFLERLVEWKRKTVGEE

SEQ ID NO: 442 - DNA, 2820 bp, Saccharomyces cerevisiae
atgactacggataacgctaaggcgcaactgacctcgtcttcagggggtaacattattgtggtgtccaacaggcttcccgtgacaatcactaaaaacagcagtacgggacagtacgagtacgcaatgtcgtccggagggctggtcacggcgttggaagggttgaagaagacgtacactttcaagtggttcggatggcctgggctagagattcctgacgatgagaaggatcaggtgaggaaggacttgctggaaaagtttaatgccgtacccatcttcctgagcgatgaaatcgcagacttacactacaacgggttcagtaattctattctatggccgttattccattaccatcctggtgagatcaatttcgacgagaatgcgtggttggcatacaacgaggcaaaccagacgttcaccaacgagattgctaagactatgaaccataacgatttaatctgggtgcatgattaccatttgatgttggttccggaaatgttgagagtcaagattcacgagaagcaactgcaaaacgttaaggtcgggtggttcctgcacacaccattcccttcgagtgaaatttacagaatcttacctgtcagacaagagattttgaagggtgttttgagttgtgatttagtcgggttccacacatacgattatgcaagacatttcttgtcttccgtgcaaagagtgcttaacgtgaacacattgcctaatggggtggaataccagggcagattcgttaacgtaggggccttccctatcggtatcgacgtggacaagttcaccgatgggttgaaaaaggaatccgtacaaaagagaatccaacaattgaaggaaactttcaagggctgcaagatcatagttggtgtcgacaggctggattacatcaaaggtgtgcctcagaagttgcacgccatggaagtgtttctgaacgagcatccagaatggaggggcaaggttgttctggtacaggttgcagtgccaagtcgtggagatgtggaagagtaccaatatttaagatctgtggtcaatgagttggtcggtagaatcaacggtcagttcggtactgtggaattcgtccccatccatttcatgcacaagtctataccatttgaagagctgatttcgttatatgctgtgagcgatgtttgtttggtctcgtccacccgtgatggtatgaacttggtttcctacgaatatattgcttgccaagaagaaaagaaaggttccttaatcctgagtgagttcacaggtgccgcacaatccttgaatggtgctattattgtaaatccttggaacaccgatgatctttctgatgccatcaacgaggccttgactttgcccgatgtaaagaaagaagttaactgggaaaaactttacaaatacatctctaaatacacttctgccttctggggtgaaaatttcgtccatgaattatacagtacatcatcaagctcaacaagctcctctgccaccggatccgctaaatctattaacatggctttgaaattggacaaggaagaaaagtccaatttagaatcaaaattatggaaagaagttcctacaattcaagattggactaataagtttttgagttcattaaaggaaaaggcgtcatctgatgatgatgtggaaaggaaaatgactccagcacttaatagacctgttcttttagaaaactacaagcaggctaagcgtagattattcctttttgattacgatggtactttgaccccaattgtcaaagacccagctgcagctattccatcggcaagactttatacaattctacaaaaattatgtgccgatcctcataatcaaatctggattatttctggtcgtgaccagaagtttttgaacaagtggttaggcggtaaacttcctcaactgggtctaagtgcggagcatggatgtttcatgaaagatgtttcttgccaagattgggtcaatttgaccgaaaaagttgatatgtcttggcaagtacgcgtcaatgaagtgatggaagaatttaccacaaggaccccaggttcattcatcgaaagaaagaaagtcgctctaacttggcattatagacgtaccgttccagaattgggtgaattccacgccaaagaactgaaagaaaaattgttatcatttactgatgacttcgatttagaggtcatggatggtaaagcaaacattgaagttcgtccaagattcgtcaacaaaggtgaaatagtcaagagactagtctggcatcaacatggcaaaccacaggacatgttgaagggaatcagtgaaaaactacctaaggatgaaatgcctgattttgtattatgtctgggtgatgacttcactgacgaagacatgtttagacagttgaataccattgaaacttgttggaaagaaaaatatcctgaccaaaaaaatcaatggggcaactacggattctatcctgtcactgtgggatctgcatccaagaaaactgtcgcaaaggctcatttaaccgatcctcagcaagtcctggagactttaggtttacttgttggtgatgtctctctcttccaaagtgctggtacggtcgacctggattccagaggtcatgtcaagaatagtgagagcagtttgaaatcaaagctagcatctaaagcttatgttatgaaaagatcggcttcttacaccggcgcaaaggtttgaaacaccctttttaacgaaatggttatgactagacagacatcttacgtcttactccttcatgctttatttttttctttgtattgtatttgaacagtcaatatgtggtgttgcgacgaaggcatatatataatagtctcaacc

SEQ ID NO: 443 - protein, 892 aa, Saccharomyces cerevisiae
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATGSAKSINMALKLDKEEKSNLESKLWKEVPTIQDWTNKFLSSLKEKASSDDDVERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 444 - DNA, 2970 bp, Saccharomyces cerevisiae
atggcgctctccctcaccaccgccttctcccacctctccctcccctccacctccaagttccacccgctccccctcctccacctccgcttcccctcctcctcctcctcccgccgcgccgcgcgcctcgcgctcgccgcctccgccgccgaggccgccgagcctgtcgaggtggaggaggcgcccgccgaggacggggcggatgaggtggtggccgtggaggacgagctgtccggaccggcgctgcgaaagtacgtgaagcagcggcttcccgggggcttcgcggcgcagcggatcactacggataacgctaaggcgcaactgacctcgtcttcagggggtaacattattgtggtgtccaacaggcttcccgtgacaatcactaaaaacagcagtacgggacagtacgagtacgcaatgtcgtccggagggctggtcacggcgttggaagggttgaagaagacgtacactttcaagtggttcggatggcctgggctagagattcctgacgatgagaaggatcaggtgaggaaggacttgctggaaaagtttaatgccgtacccatcttcctgagcgatgaaatcgcagacttacactacaacgggttcagtaattctattctatggccgttattccattaccatcctggtgagatcaatttcgacgagaatgcgtggttggcatacaacgaggcaaaccagacgttcaccaacgagattgctaagactatgaaccataacgatttaatctgggtgcatgattaccatttgatgttggttccggaaatgttgagagtcaagattcacgagaagcaactgcaaaacgttaaggtcgggtggttcctgcacacaccattcccttcgagtgaaatttacagaatcttacctgtcagacaagagattttgaagggtgttttgagttgtgatttagtcgggttccacacatacgattatgcaagacatttcttgtcttccgtgcaaagagtgcttaacgtgaacacattgcctaatggggtggaataccagggcagattcgttaacgtaggggccttccctatcggtatcgacgtggacaagttcaccgatgggttgaaaaaggaatccgtacaaaagagaatccaacaattgaaggaaactttcaagggctgcaagatcatagttggtgtcgacaggctggattacatcaaaggtgtgcctcagaagttgcacgccatggaagtgtttctgaacgagcatccagaatggaggggcaaggttgttctggtacaggttgcagtgccaagtcgtggagatgtggaagagtaccaatatttaagatctgtggtcaatgagttggtcggtagaatcaacggtcagttcggtactgtggaattcgtccccatccatttcatgcacaagtctataccatttgaagagctgatttcgttatatgctgtgagcgatgtttgtttggtctcgtccacccgtgatggtatgaacttggtttcctacgaatatattgcttgccaagaagaaaagaaaggttccttaatcctgagtgagttcacaggtgccgcacaatccttgaatggtgctattattgtaaatccttggaacaccgatgatctttctgatgccatcaacgaggccttgactttgcccgatgtaaagaaagaagttaactgggaaaaactttacaaatacatctctaaatacacttctgccttctggggtgaaaatttcgtccatgaattatacagtacatcatcaagctcaacaagctcctctgccaccggatccgctaaatctattaacatggctttgaaattggacaaggaagaaaagtccaatttagaatcaaaattatggaaagaagttcctacaattcaagattggactaataagtttttgagttcattaaaggaaaaggcgtcatctgatgatgatgtggaaaggaaaatgactccagcacttaatagacctgttcttttagaaaactacaagcaggctaagcgtagattattcctttttgattacgatggtactttgaccccaattgtcaaagacccagctgcagctattccatcggcaagactttatacaattctacaaaaattatgtgccgatcctcataatcaaatctggattatttctggtcgtgaccagaagtttttgaacaagtggttaggcggtaaacttcctcaactgggtctaagtgcggagcatggatgtttcatgaaagatgtttcttgccaagattgggtcaatttgaccgaaaaagttgatatgtcttggcaagtacgcgtcaatgaagtgatggaagaatttaccacaaggaccccaggttcattcatcgaaagaaagaaagtcgctctaacttggcattatagacgtaccgttccagaattgggtgaattccacgccaaagaactgaaagaaaaattgttatcatttactgatgacttcgatttagaggtcatggatggtaaagcaaacattgaagttcgtccaagattcgtcaacaaaggtgaaatagtcaagagactagtctggcatcaacatggcaaaccacaggacatgttgaagggaatcagtgaaaaactacctaaggatgaaatgcctgattttgtattatgtctgggtgatgacttcactgacgaagacatgtttagacagttgaataccattgaaacttgttggaaagaaaaatatcctgaccaaaaaaatcaatggggcaactacggattctatcctgtcactgtgggatctgcatccaagaaaactgtcgcaaaggctcatttaaccgatcctcagcaagtcctggagactttaggtttacttgttggtgatgtctctctcttccaaagtgctggtacggtcgacctggattccagaggtcatgtcaagaatagtgagagcagtttgaaatcaaagctagcatctaaagcttatgttatgaaaagatcggcttcttacaccggcgcaaaggtttga

SEQ ID NO: 445 - protein, 989 aa, Saccharomyces cerevisiae
MALSLTTAFSHLSLPSTSKFHPLPLLHLRFPSSSSSRRAARLALAASAAEAAEPVEVEEAPAEDGADEVVAVEDELSGPALRKYVKQRLPGGFAAQRITTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATGSAKSINMALKLDKEEKSNLESKLWKEVPTIQDWTNKFLSSLKEKASSDDDVERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 446 - protein, 723 aa, Anaeromyxobacter dehalogenans
MSRVVIVSNRLPVTVERVEDGVRVVPSVGGLATGLRRPHEQGGGPWVGWPGDLGGLEPEQVARVEARLSDLRLVPVHLTQEEVQRYYQDYSNGLLWPVFHSFLGEVPLEMGGAAEYERVNARFADAVAATARPGDVIWIHDYQLLRLPALLRERLPDARIGFFLHIPFPSSDVFRVLPNREALLEGMLGADLIGFHTASYMRHFSSSVLRVLGAWTDVDRIRWRGREVRIGVFPMGVDAADFAGTAHTAEVEEEFRGLRQDGTHLLVGIDRLDYTKGIPRRLLAYERLLREHPELRGKVRLVQVAVPSRTEVGAYQQFREQVDGLVGRIHGAFATPTWSPIHYLSRGLSRPQVVALYRAADVMLVTPIRDGMNLVAKEFVAVRGDGDGVLVLSEFTGAAAELAEAVQVNPYDAEGTAAAILRALEMPEDERRTRMAGLRRRVTRYDVHWWARTFLDRLRAPAAATPPHGLEVSARPAVEGARARLRAAPHATLLLDYDGTLVPFAPTPELARPDRELRDLLRELARHPGYSVHLVTGRQRDTVDRWFGDLGIGLHAEHGYWSKLPGTAWQLAASVSTAWREPARAILEEFAARTPGSLVEEKSAGFAWHYRTADPDFGAAQAHDLMLHLSTVLSNAPVEILPGALVVEVRPQGVDKGKVVARAAAASPEGSLLAAFGDDRTDEDMFAALPPGAISIHVGPAPSRATLRLAGVPESRAFLRGLL

SEQ ID NO: 447 - protein, 750 aa, Bacteroides vulgatus
MKLYIISNRLPVKAVAEQDTFVFSRSEGGLTTGLNSLQGNYEKHWVGWPGICTDKEEEKQDICHRLEEMNLHPIFLSDEQYKNYYEGYSNSTLWPLCHYFFAYTLYRKSFWQSYQEVNALFCREIIRLVEPDDWVWVQDYQLMLLPEMLRQELPRLHIGYFHHIPFPSYELFRILPERAEILKGLLGADFIAFHTHDYMRHFISAAERVLHMDFSLDETRIGSRIVRVDALPMGINYDLYHNVSQQKNVWKAIERTRLLFGKHKLILSVDRLDYSKGILHRLYGFASFLEHHPEYHGKVTLAMVIVPSRDHVGSYAELKTRIDEEIGSINGRYSTMNWTPVCYFYHGFSFEELAAMYFIADIALVTPLRDGMNLVAKEYIAVKQDNPGVLVLSEMAGAAVELTDALLVNPNDTEQIENAICRALEMPFEEQKERMHRMQSIVSVQTVNKWAADFVNEWQEVAHKNKTMLLKKIGSQNMQEIQHQYLHAKKRLILLDYDGTLVPFQKRPEDASPTPQLLDTLQKLTADPLNHVVINSGRDHFTLEKWLGALPISFAAEHGAFYKENGVWHKNVHAQEWSPGLLSILKLFVSKTPRSHLEVKETALAWHYRETDAWLGRLRAQQLVNSLISICLKQNLQIMQGNKVIEIKSPEFTKGSEVNRLLLATRYDFILAMGDDTTDDDMFKALPVTAVTVKIGTASESARYNLPVQTDTLPFLQRLTDKSVVKAALKSGLKGQLSSAIDFLKRIINH

SEQ ID NO: 448 - protein, 733 aa, Cytophaga hutchinsonii
MNDEKRLIIVAYRIPFKVTFKESGERVLQQNSGGLVSAILSLAEKGDVFGKNQKIHWFGYSTPDILQEGETQVENENFIVHPVLIEDALNDAYYEGFCNSTIWPISHYYPYLTSFNEEDYEAYVKANKIFADQINAFIRPGDMVWIQDYQLMLLPGMLRSENPDASIGYFHHIPFATFEIFRLLPKQWQTELLKGMIGADLVGFHTNDYSQYFLRSVQRVLGYDTTARDISIPNRIVRVDTFPISIDYNKFQELYNDPGVIEKRKEFLKDLSAEKNIFSVDRLDYSKGLIHRLNGFEYFLDQYPQWHTRVVLTMIVVPSRETILKYAEMKHELEEAVGRINGKYGTLGWRPVIYLYRSLSFEELGALYTLADVALITPIRDGMNLVAKEFVATRTDKKGVLILSEMAGASLELNGAILINPTDKRTLAAAIIQALTMDEQEQTQRMQMMQDRIRVYDIFKWTEDYMDQLDIIKLKQMEFEEKIINQDVLKSFKQIFDESSRRLFLLDYDGTLSPIVPDPSSSKPSVGIVDVLKKLSSDFNVNVAIISGRDKEFLNYIFDPNTILSAEHGAFLRIPGQDWELQYDYNDQWKRSVLPVFQKYTDRCAGSFIENKSTSLAWHYRNTEKEYAHIRSREFIEELENKVGIKSNLAIIDGDKVIEMKPSDVDKGIAARKICDLYQPDFILSIGDDRTDEDMFKALPDNALTIKVGVKNSSAKFTIKTQEEVMTILNTFL

SEQ ID NO: 449 - protein, 722 aa, Myxococcus xanthus
MSRLLLVSNRLPVTVKVEKDTVSVVRSAGGLATGLRRPHERSGGLWIGWPGDVSRLSESQRARVDAQLAELRCVPLTLSASEVSRYYEGYSNRVLWPLCHYMLERIPRQDRDWEVYRKVNERFADLVAKHYEPGDTIWVHDYQLMLVPGMLRQRLPGARIGYFHHIPFPSSEIFSTLPRRRELLKGLLGADLIGFHTVSYVRHFSGALLRHLGLDTDIDRIIWEGRDVRVGAFPMGIDAQAFESIASEPGMQEEVANLRRSSEGQRILLGIDRLDYTKGIPRRLLAVQRVLERTPAWRGRLRFIQVTVPSRTQVEAYANYRELVNELVGRINGLYGTVHNVPVHYLYRSFNERQLVGLYRGADVMLVTPVRDGMNLVAKEFCAARPDDDGVLVLSEFAGAAAELGGALIVNPYDVDAMADAIEKALGMAEEERRTRMHTLRKQVKSRDVHWWTSSFLDRLQSLPAVDVRAEASAPEALAQMKQVERLQLLLDYDGTLVGYAPRPELAAPDAALKELLAKLVARPGISVSIVSGRPKETLEEWLGDLAMGLYAEHGLWSRPAPGEAWRMLEGVTFDWKERVRPELETFSARVPGSFVEEKTASLAWHYRLVDAEFGAIQSRELRLYLAEKFAGQSMDILPGDKVVEIRPRGVHKGRVVGEATKDAAPGALVVAIGDDRTDEDLFASIPPGGLTIHAGNKPTRAAFRVNGPDEVRALLAGLLEP

SEQ ID NO: 450 - protein, 745 aa, Parabacteroides distasonis
MRLFIISNRLPVKVTRSSDGKFVFSRSEGGLATGLKSLDVDCEKHWIGWPGVCVEQKTEKDDICSQLEKNNYHPVFLSDRQYENYYEGYSNSTLWPLCHYFFAYTLYKKNFWESYREVNAVFCEEISRIVEPNDWVWVQDYQLMLLPGMLREKFPNLHIGYFHHIPFPSHELFRILPERVEILNGLLGADFVAFHIHDYMRHFISATERILHKNFNLDEVQMNDRVTRVDALPMGINYDLYHNVIADDKVHHAVEKTRLLFGDHKLIISVDRLDYSKGILHRLYGFASFLKNHPEYHGKVTLAMVIVPSRDHVGSYAELKTKIDEEIGSINGTYSTMNWTPVCYFYHGFSFEELVAMYYVADIALVTPLRDGMNLVAKEYVATKQDNPGVLILSEMAGASVELSDALLINPNDTDQIEQAICRALKMPLEEQRERLQRMQAILSVQTVNKWAADFMREWRQAAEKNKRLQKKKISAQDQNEIKTLYDQAKKRLILLDYDGTLTAFKNHPEDAAPTPALRDLLQRFCSDSRNHVTINSGRDHYTLEKWLGDLPLSFAAEHGAFYKEKGAWHKNIGNREWDSELLFILNLFVSKTPYSHLETKEAALAWHYRESDAWLGELRAQQLTKAIMPVCLRKGLQIMQGNKVVEIKSPEYTKGSEVDRLLLASRYDFILAMGDDTTDEDMFRALPVSAITVKVGIVSEKAKYNLSSQEEVLPFLEELSGEGVSYGTTSRSIKGQLKATVDFF

SEQ ID NO: 451 - protein, 949 aa, Aspergillus fumigatus
MAANQDTPTKVPDGQPNPVMVGPGMKSLGEEAYTNASNATPSLETDKKHPLVNDAPSYFSQVPGTKQSSTVSDTALPGSPADAARDAKSPIELLRRLSLGRSPMIPDVDPREQYPGLNLTGRIISAAFCIPYKVGYRPGSDWDLKPRPGTSALFDSFAYLGSGETKWSHTLVGWTGEVEPIQDVSVPLQHIPVSSGARLPPALNGVAVPLNKAAAPVPVDSKQRPPSHPLLEGFRVSQEDRARLDAQLSSGRYGKIAPVWLSDESEEPEESSIFLEDQGRWRRYAEKELYPLLHYKQHGPTDGRSERKWWGDYVRMNRLFADRIIEEYQEGDIVWIHDYHLFLLPSLLRQRIPNIYIGFFLHAPFPSSEFMRCLAKRKEVLTGVLGANMIGFQTFSYSRHFSSCCTRVLGFDSNNAGVDAYGAHVAVDVFPIGIDVKAIQKAAYGYPEIEEAVVGLRTLYAGKKIIVGRDRLDSVRGVAQKLQAFEQFLERYPEWREKVVLIQVTSPTSVEEEKEDPENKIASQISNLVSTINGRFGSISFSPVKYYPQYLSQHEYFALLRVADVGLITTVRDGMNTTSLEYILCQHNTHGPLILSEFSGTAGTLSSAIHINPWDTTGVAEAINRALTMSPEEKKAQHVKLYKHVTTNTISTWSNHFVTRLLTNLSSFDQSVATPALDRAKLLKQYRKARKRLFMFDYDGTLTPIVKDPQAAIPSDRVLRTLKTLAADPRNAVWIISGRDQAFLDEWMGHIPELGLSAEHGCFIRQPRSDDWENLAESSDMGWQKEVMEVFQHFTERTQGSFIERKRVALTWHYRRADPEYGAFQARECRKMLEETVAKRWEVEVMAGKANLEVRPTFVNKGFIAARLVQEYGTDPAQAPEFVLCLGDDFTDEDMFRALKKSGLPAGHVFSVTVGASSKQTEASWHLLEPADVIGTISMLNNSSSAQEY

SEQ ID NO: 452 - protein, 940 aa, Aspergillus terreus
MSSPPHNSPPTIVAGMQPGTVKIESDTNRAAPSSNASGFPFPPIPEHDQPPPLSSAESKSPAPTEPITPATPAQAAQNAKSGMELLRRLSLQGTPTVLEMDPKEQHPGLNLTGRIISAAFCIPYKVYYRSGGDWELKPRPGTSALFDSFAYLGSEETRWSHTLVGWTGEVEPVEEDVVPLQHIPVNTSAKLPTAVNGTGLALNKAAAPVPVDAHQRPPSHPLLDGFSIGPKDRERLDQQLSSGRYGKIAPVWLSAESEVPDDSIFLEDQGRWRRYAERELYPLLHYKQHGPTDGRSEIKWWTDYVRMNRLFADRIVKEYQEGDIVWIHDYHLFLLPSMLRQRIPNIYIGFFLHAPFPSSEFMRCLAKRKEVLTGVLGANMIGFQTFSYSRHFSSCCTRVLGFDSNSAGVDAYGAHVAVDVFPIGIDVKALQRKAFGSPEIEKAVEGIRKLYEGKKIIVGRDRLDSVRGVAQKLQAFEVFLERYPEWRDKVVLIQVTSPTSVDEEKEENKIAAQISNLVSTIHGRFGSLSFSPVKYYPQYLSQDEYFALLRTADVGLITTVRDGMNTTGLEYIICQQNNYGPLILSEFSGTAGTLSSAIHINPWDTAGVADAINQALTMPEDLRRMQHQKLYKHVITNTVATWSKQFLTRLLTNLSSFDQSVATPALDRAKLVKQYRKARRRLFMFDYDGTLTPIVKDPQAAIPSDRVLRTIKSLAADPRNDVWIISGRDQAFLDEWMGHIPELGLSAEHGCFIRKPHSDDWENLAERSDMGWQKEVMETFQHYTERTQGSFIERKRVALTWHYRRADPEYGAFQARECRRQLEETVGRKWEVEVMAGKANLEVRPTFVNKGFIATRLVNEYGHGPGKAPEFIFCSGDDFTDEDMFRALRKFDLPQDHVYSVTVGASSKQTAASWHLLEPADVIETISMLNSSSSQEYRTQ

SEQ ID NO: 453 - protein, 888 aa, Candida albicans
MAPQQVNAFSANGSIPSPKEFEGKGKLKLSGRILNVMTSLPLQIISDYDNKTGQYYWDVETVRGNSALYSSQHFLAENKEWETHLIAWTGELINKKKDTSSLTADTLQDDPLYLDEEDKSKIEKKLCDASGTPNIHPVWLLRRDQGRWRKYAENVLWPVFHYIQGQPSDGKAETDAWHDYVKFNEAYLNKIKSVYKPGDIIWIHDYYLLLLPQLLRMEFPNAYIGFFLHVPFPSSEYFRCLSKRSQLLDGMLGADKIGFQSDSFQRHFISCCARVLGCEVNRDSVSAYGTTISVETLPIGIDTEKIEHDAFSSELGVEEKVQALKQVYKGKKLIVGRDRLDKVRGVIQKLEGFEIFLDMYPEWRETVVLIQVSSPGYSHSANVETRVTEIISRINSKYGNLNHTPVLHYQMRVAKEEYLALLRVADLALITSVRDGMNTTSLEFVICQKYNNSPLILSEFTGTATVLKDAIMVNPWDSVGVAKTINDALMLSTKEKVSLESKLYEKVLSNTVQNWTSTFICDILSHSIVTHSNSYTPALNRPLLLNNYKESQRRLFLFDYDGTLTPIVQDPAAAIPSDKLNRILDVLSSDPKNQIWIISGRDQAFLEKWMGNKNVGLSAEHGCFMKDIGSKEWVNLAASFDMSWQEKVDDIFKYYTEKTPGSNIERKKVALTWHYRRADPDLGNFQAEKCMKELNDTVAKEYDVEVMAGKANIEVRPKFVNKGEIVKRLVLHPHGAKQEKHPTGHCTKDIPIEELPDFMLCLGDDLTDEDMFNSLNEINKKWKGDNRPTNKFGSYGVYPVAVGPASKKTVAIAHLNEPRQVLETLGLLAGLVSIFESAGTVDLDDRGHLANSVSSERSKHAVSKAVSLRKKASQEKEIVKEDPTNGAK

SEQ ID NO: 454 - protein, 877 aa, Pichia stipitis
METKFAYPSDSTIISPADYANNSKIKLSGRVLNVMTSLPSQIYKCHDPKTHEYIWDVEPVRGNSALYSSQYFLDQHTDWETHLIAWTGELINNTNLSANGENIQDDPLYLDDKEKQELEKKLRKANNSDNIHPVWLLRRDQERWRKYAENVLWPVFHYIQGQPSNGKAEADAWHDYVKFNEVYCNKIKSVYKPGDIIWIHDYYLLLLPQLLRMEFPDAYIGLYVHAPFPSSEYFRCLSKRSQLLDGMLGADKIAFQSDSFQRHFLSCCSRLLGYEVTSNKILAYGTAISVETLPIGIDTKKTENDAFEPGIEVKVKALKEIYTGKKIIVGRDRLDKVRGVVQKLQAFEMFLQMYPEWRDKVVLIQVSSPGYSHSANVEKKVTELVNRINSQFGNLNYTPVLHYQIRIEKDEYFALLRVADLALVTSVRDGMSTTSLEFVICQKENSSPLILSEFTGTASVLRESILVNPWDSVGIARTINDCLSMSDDAKTDLEGRLYKQVISNTIQSWSSTFLSHLIEHVSETHTFHYTPALNRPLLYNSYAKSERRLFLFDYDGTLTPIVKDPAAAIPSSRLNQILDALSADPKNQIWVISGRDQAFLDKWLGSKNVGFSAEHGCFMKDIDSKEWVNLAESFDMSWQQKVDSVYRYYTERTPGSNIERKKVALTWHYRRADPELGRFQAAKCFQQLKDTVAKEYDVEIMEGKANIEVRPKFLNKGEIVRRLVLNPHGSKLDTHISSKGSADISVADLPDFILCLGDDLTDEDMFRALKEIEDDWTSKEFPKNQFGSYGVYPVAVGPASKQTIATSHLNEPSQVLETLGLLAGQVSLFESAGTVDLDDRGHVANSPSSERSKTAIKEAALRRKVSLSKVIESKEKI

SEQ ID NO: 455 - DNA, 294 bp, Artificial sequence
  Rbcs chl targeting signalling
atggcgctctccctcaccaccgccttctcccacctctccctcccctccacctccaagttccacccgctccccctcctccacctccgcttcccctcctcctcctcctcccgccgcgccgcgcgcctcgcgctcgccgcctccgccgccgaggccgccgagcctgtcgaggtggaggaggcgcccgccgaggacggggcggatgaggtggtggccgtggaggacgagctgtccggaccggcgctgcgaaagtacgtgaagcagcggcttcccgggggcttcgcggcgcagcggatc

SEQ ID NO: 456 - protein, 98 aa, Artificial sequence
  Rbcs chl targeting signalling
MALSLTTAFSHLSLPSTSKFHPLPLLHLRFPSSSSSRRAARLALAASAAEAAEPVEVEEAPAEDGADEVVAVEDELSGPALRKYVKQRLPGGFAAQRI

SEQ ID NO: 457 - DNA, 2194 bp, Oryza sativa; identical to SEQ ID NO: 91

SEQ ID NO: 458 - protein, 50 aa, Artificial sequence
  motif 29: Class I - motif I
  VARIANT (2)..(2): / replace = "Gln"
  VARIANT (7)..(7): / replace = "Ile"
  VARIANT (19)..(19): / replace = "Gln"
  VARIANT (20)..(20): / replace = "Tyr"
  VARIANT (23)..(23): / replace = "Asp"
  VARIANT (24)..(24): / replace = "His"
  VARIANT (25)..(25): / replace = "Asp"
  VARIANT (26)..(26): / replace = "Ile" / replace = "Asn"
  VARIANT (27)..(27): / replace = "Asn"
  VARIANT (44)..(44): / replace = "His"
  VARIANT (45)..(45): / replace = "Lys"
YEEGDVVWCHDYHLMFLPKCLKEYNSKMKVGWFLHTPFPSSEIYRTLPSR

SEQ ID NO: 459 - protein, 50 aa, Artificial sequence
  motif 30: Class I - motif II
  VARIANT (2)..(2): / replace = "Lys"
  VARIANT (15)..(15): / replace = "His"
  VARIANT (16)..(16): / replace = "Ser"
  VARIANT (20)..(20): / replace = "Phe"
  VARIANT (25)..(25): / replace = "Glu"
  VARIANT (34)..(34): / replace = "Ala"
  VARIANT (39)..(39): / replace = "Leu"
  VARIANT (45)..(45): / replace = "Ala"
FEYFTERTPRSHFETRETSLVWNYKYADVEFGRLQARDMLQHLWTGPISN

SEQ ID NO: 460 - protein, 50 aa, Artificial sequence
  motif 31: Class I - motif III
  VARIANT (15)..(15): / replace = "Tyr"
  VARIANT (26)..(26): / replace = "Ala"
  VARIANT (27)..(27): / replace = "Asn"
  VARIANT (35)..(35): / replace = "Val"
  VARIANT (43)..(43): / replace = "Asn"
GVDRLDMIKGIPQKILAFEKFLEENPEWRDKVVLLQIAVPTRTDVPEYQK

SEQ ID NO: 461 - protein, 50 aa, Artificial sequence
  motif 32: Class I-II - motif I
  VARIANT (2)..(2): / replace = "Trp"
  VARIANT (6)..(6): / replace = "Thr"
  VARIANT (19)..(19): / replace = "Ser"
  VARIANT (21)..(21): / replace = "Glu" / replace = "Ser"
  VARIANT (23)..(23): / replace = "Ile"
  VARIANT (25)..(25): / replace = "Lys"
  VARIANT (26)..(26): / replace = "Ser"
  VARIANT (27)..(27): / replace = "Val"
  VARIANT (30)..(30): / replace = "Cys"
  VARIANT (33)..(33): / replace = "Val"
  VARIANT (38)..(38): / replace = "Tyr"
  VARIANT (45)..(45): / replace = "Val"
  VARIANT (47)..(47): / replace = "Ala"
  VARIANT (49)..(49): / replace = "Thr"
GFFLHSPFPSSEIYRTLPVRDELLRALLNADLIGFHTFDYARHFLSCCSR

SEQ ID NO: 462 - protein, 50 aa, Artificial sequence
  motif 33: Class I-II - motif II
  VARIANT (1)..(1): / replace = "Tyr"
  VARIANT (2)..(2): / replace = "Ala"
  VARIANT (4)..(4): / replace = "Arg"
  VARIANT (5)..(5): / replace = "Thr"
  VARIANT (6)..(6): / replace = "Leu"
  VARIANT (7)..(7): / replace = "Leu" / replace = "Ile"
  VARIANT (12)..(12): / replace = "Arg"
  VARIANT (13)..(13): / replace = "Leu"
  VARIANT (15)..(15): / replace = "Met"
  VARIANT (16)..(16): / replace = "Ile"
  VARIANT (20)..(20): / replace = "Pro"
  VARIANT (21)..(21): / replace = "Gln"
  VARIANT (23)..(23): / replace = "Ile"
  VARIANT (26)..(26): / replace = "Met"
  VARIANT (28)..(28): / replace = "Lys"
  VARIANT (29)..(29): / replace = "Phe"
  VARIANT (32)..(32): / replace = "Glu"
  VARIANT (33)..(33): / replace = "Asn"
  VARIANT (35)..(35): / replace = "Lys"
  VARIANT (36)..(36): / replace = "Leu"
  VARIANT (37)..(37): / replace = "Gln"
  VARIANT (38)..(38): / replace = "Asp"
  VARIANT (39)..(39): / replace = "Arg"
  VARIANT (40)..(40): / replace = "Ala"
  VARIANT (43)..(43): / replace = "Leu"
  VARIANT (47)..(47): / replace = "Val"
  VARIANT (49)..(49): / replace = "Thr"
FKGKKVMLGVDDMDIFKGISLKLLAFEQLLEQHPEWRGKVVLVQIANPAR

SEQ ID NO: 463 - protein, 29 aa, Artificial sequence
  motif 34: Class I-II - motif III
  VARIANT (2)..(2): / replace = "Leu"
  VARIANT (4)..(4): / replace = "Thr"
  VARIANT (5)..(5): / replace = "Val"
  VARIANT (6)..(6): / replace = "Thr"
  VARIANT (7)..(7): / replace = "Asp"
  VARIANT (8)..(8): / replace = "Val"
  VARIANT (9)..(9): / replace = "Val"
  VARIANT (10)..(10): / replace = "Val"
  VARIANT (12)..(12): / replace = "Asn"
  VARIANT (13)..(13): / replace = "Ser"
  VARIANT (14)..(14): / replace = "Leu"
  VARIANT (21)..(21): / replace = "Ile"
  VARIANT (22)..(22): / replace = "Ser"
  VARIANT (25)..(25): / replace = "Phe"
  VARIANT (26)..(26): / replace = "Val" / replace = "Thr"
  VARIANT (27)..(27): / replace = "Ala"
  VARIANT (29)..(29): / replace = "Gln"
AYYAIAECCLVTAVRDGMNLVPYEYIVCR

SEQ ID NO: 464 - protein, 50 aa, Artificial sequence
  motif 35: Class III - motif IV
  VARIANT (19)..(19): / replace = "Glu"
  VARIANT (25)..(25): / replace = "Val"
  VARIANT (27)..(27): / replace = "Thr"
  VARIANT (28)..(28): / replace = "Glu"
  VARIANT (29)..(29): / replace = "Lys"
  VARIANT (32)..(32): / replace = "Arg"
  VARIANT (33)..(33): / replace = "Thr"
  VARIANT (35)..(35): / replace = "Lys"
  VARIANT (36)..(36): / replace = "Gly"
  VARIANT (37)..(37): / replace = "Leu"
  VARIANT (39)..(39): / replace = "Arg"
  VARIANT (40)..(40): / replace = "Cys"
  VARIANT (47)..(47): / replace = "Thr"
GKQIVMFLDYDGTLSPIVDDPDRAFMSDEMREAVRKVAKHFPTAIVSGRC

SEQ ID NO: 465 - protein, 32 aa, Artificial sequence
  motif 36: Class III - motif V
  VARIANT (6)..(6): / replace = "Phe"
  VARIANT (8)..(8): / replace = "Val"
  VARIANT (11)..(11): / replace = "Ser"
  VARIANT (29)..(29): / replace = "Tyr"
  VARIANT (30)..(30): / replace = "Glu"
  VARIANT (32)..(32): / replace = "Ser"
QGRKVLEIRPTIKWDKGKALEFLLESLGFANC

SEQ ID NO: 466 - protein, 29 aa, Artificial sequence
  motif 37: Class III - motif VI
  VARIANT (2)..(2): / replace = "Val"
  VARIANT (24)..(24): / replace = "Ile"
PIYIGDDRTDEDAFKVLRNRGQGFGILVS

SEQ ID NO: 467 - protein, 8 aa, Artificial sequence
  motif 38: Class III - motif VII
  VARIANT (2)..(2): / replace = "Ala"
  VARIANT (3)..(3): / replace = "Val"
  VARIANT (4)..(4): / replace = "Thr"
  VARIANT (5)..(5): / replace = "Trp"
  VARIANT (7)..(7): / replace = "Phe"
FCLSVHYR

SEQ ID NO: 468 - protein, 5 aa, Artificial sequence
  motif 39: Class III - motif VIII
LDYDG

SEQ ID NO: 469 - protein, 6 aa, Artificial sequence
  motif 40: Class III - motif IX
GDDRTD

SEQ ID NO: 470 - protein, 36 aa, Artificial sequence
  from Arabidopsis thaliana P450 protein (AEB16913, SEQ ID NO: 282)
MESSLFSPSSSSYSSLFTAKPTRLLSPKPKFTFSIR

SEQ ID NO: 471 - protein, 72 aa, Artificial sequence
  transit peptide from Arabidopsis COS1 (COI1 suppressor 1)
MKSLASPPCLRLIPTAHRQLNSRQSSSACYIHGGSSVNKSNNLSFSSSTSGFASPLAVEKELRSSFVQTAAV

SEQ ID NO: 472 - protein, 62 aa, Artificial sequence
  transit peptide from tomato rubisco small subunit (AAM50960)
MASSVISSAAVATRSNVTQASMVAPFTGLKSSATFPVTKKQNLDITSIASNGGRVSCMQVWH

SEQ ID NO: 473 - protein, 49 aa, Artificial sequence
  transit peptide from corn SSU (AEE66528)
MAPTVMMASSATAVAPFLGLKSTASLPVARRSSRSLGNVSNGGRIRCMQ

SEQ ID NO: 474 - protein, 32 aa, Artificial sequence
  transit peptide from corn AS1
MATASLALSLRLAPSSRPLSLRRRGAAGVTCR

SEQ ID NO: 475 - protein, 47 aa, Artificial sequence
  transit peptide from AS2
MESLAATSVFAPSRVAVPAARALVRAGTVVPTRRTSSRSGTSGVKCS

SEQ ID NO: 476 - protein, 69 aa, Artificial sequence
  transit peptide from spinach (AAY97391)
MALSTSLSLVSPKLSQQNLTFCTFNNQPSSLNGHIKFNPNLRNSVSKLFITTQNTRFLKFRYVRNQINS

SEQ ID NO: 477 - protein, 73 aa, Artificial sequence
  transit peptide from Ipomoea batata ADP-glucose phosphorylase
MAAATIGALSSPYTGGVGERIDGDVSKASFRRLSFASSHLSGDKLMPLPPRRLRSGGKSSEVRTAPFIVSPKA

SEQ ID NO: 478 - protein, 48 aa, Artificial sequence
  Transit peptide from rice SGR (stay green gene, Os09g0532000)
MAAATSTMSLLPPITQQQRWHAADSLVVLASRCHNSRRRRRCRYVVPR

SEQ ID NO: 479 - protein, 56 aa, Artificial sequence
  transit peptide from soybean rubisco small subunit precursor (AAA82069)
MASSMISSPAVTTVNRAGAGMVAPFTGLKSMAGFPTRKTNNDITSIASNGGRVQCM

SEQ ID NO: 480 - protein, 54 aa, Artificial sequence
  transit peptide from Populus alba isoprene synthase (ABV04402)
MATELLCLHRPISLTHKLFRNPLPKVIQATPLTLKLRCSVSTENVSFTETETEA

SEQ ID NO: 481 - protein, 89 aa, Artificial sequence
  modified transit peptide for chloroplast targeting (CAA48415)
MASSMLSSATMVASPAQATMVAPFNGLKSSAAFPATRKANNDITSITSNGGRVNCMQVWPPIGKKKFETLSYLPDLTDSGGRVNCMQAM

SEQ ID NO: 482 - protein, 54 aa, Artificial sequence
  transit peptide from Arabidopsis RbcS-TP
MASSMLSSATMVASPAQATMVAPFNGLKSSAAFPATRKANNDITSITSNGGRVN

SEQ ID NO: 483 - protein, 59 aa, Artificial sequence
  transit peptide from Arabidopsis E1alpha subunit of pyruvate dehydrogenase
MATAFAPTKLTATVPLHGSHENRLLLPIRLAPPSSFLGSTRSLRRLNHSNATRRSPVVS

SEQ ID NO: 484 - protein, 70 aa, Artificial sequence
  transit peptide from pea carbonic anhydrase
MSTSSINGFSLSSLSPAKTSTKRTTLRPFVFASLNTSSSSSSSSTFPSLIQDKPVFASSSPIITPVLREE

SEQ ID NO: 485 - protein, 71 aa, Artificial sequence
  Transit peptide from Flaveria pringlei CA3
MYATAAAFAPSFTTSRRKPSSSSSTVSTCFARLSNSAQSSSSSATPPPSLIRNQPVFAAPTPIITPTVRGD

SEQ ID NO: 486 - protein, 88 aa, Artificial sequence
  88 aa non canonical TP from Pea
MHSVIKGGWRPTFALAKKNDSQERKTRIRLSKDKRKAMVESFIKKYQESNGGNFPPITVTHKEVGGSFYTVREIVREVIQENRVLGPA

SEQ ID NO: 487 - protein, 63 aa, Artificial sequence
  transit peptide from Arabiodpsis BCCP
MASSSSFSVTSPAAAASVYAVTGTSSHFPIQNRSRRVSRFRLSAKPKLRFLSKPSRSSYPVVK

SEQ ID NO: 488 - protein, 71 aa, Artificial sequence
  transit peptide from Arabiodpsis GLU2
MALQSPGATGASSSVSRLLSSAKLSSTKTIFSVDFVRSYCISKGTKRRNELSGFRGYSPLLKSSLRSFSVK

SEQ ID NO: 489 - protein, 29 aa, Artificial sequence
  transit peptide from ATP synthase delta subunit protein of Bigelowiella natans (chlorarachniophyte algae)
HVGSAIVRTPTSTFSMPSIRTPMMGRNLR

SEQ ID NO: 490 - protein, 50 aa, Artificial sequence
  transit peptide from  Fdx1 of Bigelowiella natans (chlorarachniophyte algae)
DQQLGAGLAMRAPAVGARVLRTPGNQCLRVSGKNPFSRVAVSAIHAPMTA

SEQ ID NO: 491 - protein, 60 aa, Artificial sequence
  Transit peptide from  RpL28 of Bigelowiella natans (chlorarachniophyte algae)
ALVSFRTSTTGGENLEAVMSTISRNVAVNGRRNQIASGRRCGLTGKSGTTAYKYCFSHKR

SEQ ID NO: 492 - protein, 12 aa, Artificial sequence
  motif 1
  VARIANT (1)..(1): / replace = "Cys" / replace = "Ala" / replace = "Gly" / replace = "Pro"
  VARIANT (2)..(2): / replace = "Tyr" / replace = "Pro" / replace = "Gly"
  VARIANT (3)..(3): / replace = "Val" / replace = "Met"
  VARIANT (4)..(4): / replace = "Asn"
  VARIANT (10)..(10): / replace = "Val" / replace = "Leu"
  VARIANT (11)..(11): / replace = "Ala" / replace = "Phe" / replace = "Ile" / replace = "Val"
SHIESLDYEINE

SEQ ID NO: 493 - protein, 12 aa, Artificial sequence
  motif 1
  VARIANT (1)..(1): / replace = "Ala" / replace = "Gly" / replace = "Pro"
  VARIANT (2)..(2): / replace = "Tyr" / replace = "Pro" / replace = "Gly"
  VARIANT (3)..(3): / replace = "Val" / replace = "Met"
  VARIANT (4)..(4): / replace = "Asn"
  VARIANT (10)..(10): / replace = "Val" / replace = "Leu"
  VARIANT (11)..(11): / replace = "Ile" / replace = "Val"
SHIESLDYEINE

SEQ ID NO: 494 - protein, 19 aa, Artificial sequence
  motif 2
  VARIANT (2)..(2): / replace = "Ala" / replace = "Ser"
  VARIANT (6)..(6): / replace = "Ser"
  VARIANT (11)..(11): / replace = "Ile"
  VARIANT (13)..(13): / replace = "Gly"
  VARIANT (18)..(18): / replace = "Val"
PTAAGPGIPEVKAYLNGID

SEQ ID NO: 495 - protein, 18 aa, Artificial sequence
  motif 3
  VARIANT (2)..(2): / replace = "Cys" / replace = "Asn"
  VARIANT (4)..(4): / replace = "Cys" / replace = "Phe" / replace = "Ala" / replace = "Ser" / replace = "Thr"
  VARIANT (5)..(5): / replace = "Ser" / replace = "Gly"
  VARIANT (7)..(7): / replace = "Ser" / replace = "Gly"
  VARIANT (8)..(8): / replace = "Ser" / replace = "Gly"
  VARIANT (9)..(9): / replace = "Ser"
  VARIANT (10)..(10): / replace = "Phe"
  VARIANT (11)..(11): / replace = "Ala" / replace = "Leu" / replace = "Val" / replace = "Ile" / replace = "His" / replace = "Phe"
  VARIANT (12)..(12): / replace = "Val" / replace = "Ile"
  VARIANT (15)..(15): / replace = "Ala"
  VARIANT (18)..(18): / replace = "Met"
GSIGAVAAGLDLGKEGPL

SEQ ID NO: 496 - protein, 18 aa, Artificial sequence
  motif 3
  VARIANT (4)..(4): / replace = "Cys"
  VARIANT (5)..(5): / replace = "Ser"
  VARIANT (7)..(7): / replace = "Ser" / replace = "Gly"
  VARIANT (8)..(8): / replace = "Ser" / replace = "Gly"
  VARIANT (11)..(11): / replace = "Ala" / replace = "Ile"
  VARIANT (12)..(12): / replace = "Val"
GSIGAVAAGLDLGKEGPL

SEQ ID NO: 497 - protein, 17 aa, Artificial sequence
  motif 4
  VARIANT (13)..(13): / replace = "Thr"
  VARIANT (14)..(14): / replace = "Ser"
PVGGVLFALEEVATWWR

SEQ ID NO: 498 - protein, 15 aa, Artificial sequence
  motif 5
  VARIANT (2)..(2): / replace = "Arg" / replace = "Asn" / replace = "His" / replace = "Ile"
  VARIANT (5)..(5): / replace = "Met" / replace = "His"
  VARIANT (6)..(6): / replace = "Ala"
  VARIANT (8)..(8): / replace = "Lys" / replace = "Glu" / replace = "Gly"
  VARIANT (11)..(11): / replace = "Phe"
  VARIANT (13)..(13): / replace = "Leu" / replace = "Ile"
  VARIANT (14)..(14): / replace = "Tyr" / replace = "Trp"
GKCGLFGSGGLIMFD

SEQ ID NO: 499 - protein, 5 aa, Artificial sequence
  motif 6
  VARIANT (3)..(3): / replace = "Gly" / replace = "Ala"
  VARIANT (4)..(4): / replace = "Met"
  VARIANT (5)..(5): / replace = "Ala"
YNDLS

SEQ ID NO: 500 - protein, 5 aa, Artificial sequence
  motif 6
  VARIANT (5)..(5): / replace = "Ala"
YNDLS

SEQ ID NO: 501 - protein, 9 aa, Artificial sequence
  motif 7
GSMRMTVSL

SEQ ID NO: 502 - protein, 15 aa, Artificial sequence
  motif 8
  VARIANT (2)..(2): / replace = "Ile" / replace = "Leu" / replace = "Val" / replace = "Met"
  VARIANT (5)..(5): / replace = "Phe" / replace = "Val"
  VARIANT (6)..(6): / replace = "Val"
  VARIANT (7)..(7): / replace = "Ser"
  VARIANT (9)..(9): / replace = "Ala" / replace = "Ser"
  VARIANT (11)..(11): / replace = "Ala"
  VARIANT (12)..(12): / replace = "Asn"
  VARIANT (13)..(13): / replace = "Ala" / replace = "Phe" / replace = "Cys" / replace = "Gly" / replace = "Val"
MFVLLIAKTVGDSFN

SEQ ID NO: 503 - protein, 15 aa, Artificial sequence
  motif 8
  VARIANT (2)..(2): / replace = "Ile" / replace = "Leu" / replace = "Val" / replace = "Met"
  VARIANT (7)..(7): / replace = "Ser"
  VARIANT (9)..(9): / replace = "Ala" / replace = "Ser"
  VARIANT (13)..(13): / replace = "Ala" / replace = "Phe"
MFVLLIAKTVGDSFN

SEQ ID NO: 504 - protein, 477 aa, Artificial sequence
  Consensus
  misc_feature (3)..(3): Xaa can be any naturally occurring amino acid
  misc_feature (6)..(6): Xaa can be any naturally occurring amino acid
  misc_feature (9)..(10): Xaa can be any naturally occurring amino acid
  misc_feature (12)..(13): Xaa can be any naturally occurring amino acid
  misc_feature (18)..(18): Xaa can be any naturally occurring amino acid
  misc_feature (20)..(20): Xaa can be any naturally occurring amino acid
  misc_feature (23)..(23): Xaa can be any naturally occurring amino acid
  misc_feature (27)..(28): Xaa can be any naturally occurring amino acid
  misc_feature (31)..(31): Xaa can be any naturally occurring amino acid
  misc_feature (36)..(36): Xaa can be any naturally occurring amino acid
  misc_feature (43)..(43): Xaa can be any naturally occurring amino acid
  misc_feature (45)..(89): Xaa can be any naturally occurring amino acid
  misc_feature (91)..(92): Xaa can be any naturally occurring amino acid
  misc_feature (94)..(94): Xaa can be any naturally occurring amino acid
  misc_feature (96)..(96): Xaa can be any naturally occurring amino acid
  misc_feature (99)..(99): Xaa can be any naturally occurring amino acid
  misc_feature (102)..(103): Xaa can be any naturally occurring amino acid
  misc_feature (105)..(157): Xaa can be any naturally occurring amino acid
  misc_feature (159)..(159): Xaa can be any naturally occurring amino acid
  misc_feature (161)..(161): Xaa can be any naturally occurring amino acid
  misc_feature (164)..(171): Xaa can be any naturally occurring amino acid
  misc_feature (173)..(173): Xaa can be any naturally occurring amino acid
  misc_feature (175)..(176): Xaa can be any naturally occurring amino acid
  misc_feature (178)..(191): Xaa can be any naturally occurring amino acid
  misc_feature (193)..(219): Xaa can be any naturally occurring amino acid
  misc_feature (222)..(222): Xaa can be any naturally occurring amino acid
  misc_feature (224)..(224): Xaa can be any naturally occurring amino acid
  misc_feature (230)..(230): Xaa can be any naturally occurring amino acid
  misc_feature (248)..(248): Xaa can be any naturally occurring amino acid
  misc_feature (251)..(254): Xaa can be any naturally occurring amino acid
  misc_feature (261)..(262): Xaa can be any naturally occurring amino acid
  misc_feature (264)..(269): Xaa can be any naturally occurring amino acid
  misc_feature (276)..(277): Xaa can be any naturally occurring amino acid
  misc_feature (293)..(294): Xaa can be any naturally occurring amino acid
  misc_feature (302)..(303): Xaa can be any naturally occurring amino acid
  misc_feature (306)..(306): Xaa can be any naturally occurring amino acid
  misc_feature (312)..(312): Xaa can be any naturally occurring amino acid
  misc_feature (320)..(320): Xaa can be any naturally occurring amino acid
  misc_feature (325)..(329): Xaa can be any naturally occurring amino acid
  misc_feature (343)..(343): Xaa can be any naturally occurring amino acid
  misc_feature (348)..(348): Xaa can be any naturally occurring amino acid
  misc_feature (350)..(350): Xaa can be any naturally occurring amino acid
  misc_feature (352)..(352): Xaa can be any naturally occurring amino acid
  misc_feature (359)..(370): Xaa can be any naturally occurring amino acid
  misc_feature (372)..(372): Xaa can be any naturally occurring amino acid
  misc_feature (376)..(376): Xaa can be any naturally occurring amino acid
  misc_feature (379)..(390): Xaa can be any naturally occurring amino acid
  misc_feature (396)..(397): Xaa can be any naturally occurring amino acid
  misc_feature (407)..(407): Xaa can be any naturally occurring amino acid
  misc_feature (409)..(410): Xaa can be any naturally occurring amino acid
  misc_feature (412)..(412): Xaa can be any naturally occurring amino acid
  misc_feature (416)..(416): Xaa can be any naturally occurring amino acid
  misc_feature (418)..(418): Xaa can be any naturally occurring amino acid
  misc_feature (420)..(420): Xaa can be any naturally occurring amino acid
  misc_feature (426)..(429): Xaa can be any naturally occurring amino acid
  misc_feature (432)..(432): Xaa can be any naturally occurring amino acid
  misc_feature (446)..(447): Xaa can be any naturally occurring amino acid
  misc_feature (459)..(459): Xaa can be any naturally occurring amino acid
  misc_feature (471)..(471): Xaa can be any naturally occurring amino acid
LSXILXLLXXAXXASHAXLXPEXYWKXXLPXTPMPXAIRDLLXPXXXXXXXXXXXXXXXXXXXXXXXXXXXXXXXXXXXXXXXXXXXXXEXXTXVXVGXGGXXVXXXXXXXXXXXXXXXXXXXXXXXXXXXXXXXXXXXXXXXXXXXXXXXXXXXXXTXVXVGXXXXXXXXVXVXXGXXXXXXXXXXXXXXVXXXXXXXXXXXXXXXXXXXXXXXXXXXPFXYXYAASEXQLHDDPNVALFFLEKDLXPGXXXXMTLHFTXXTXXXXXXAAFLPRXXADSIPFSSEKLPEILXXFSVKPGSXXAEXMKNTIXECEAPAIXGEEKXXXXXYCATSLESMVDFSXSKLGXKXVXAVSTEVXXXXXXXXXXXXQXYTIXAGXXXXXXXXXXXXVVCHKXXYAYAVFYCHXTXXTXRAYXVXLXGADGTXXXXRAXAVAVCHTDTSAWNXXPKHLAFQVLKVXPGTVPVCHFLPXDHVVWV

SEQ ID NO: 505 - protein, 59 aa, Arabidopsis thaliana
HYRGVRQRPWGKFAAEIRDPAKNGARVWLGTFETAEDAALAYDRAAFRMRGSRALLNFP

SEQ ID NO: 506 - protein, 58 aa, Arabidopsis thaliana
KFRGVRQRHWGSWVAEIRHPLLKRRIWLGTFETAEEAARAYDEAAVLMSGRNAKTNFP

SEQ ID NO: 507 - protein, 58 aa, Arabidopsis thaliana
RYKGIRMRKWGKWVAEIREPNKRSRIWLGSYKTAVAAARAYDTAVFYLRGPSARLNFP

SEQ ID NO: 508 - protein, 58 aa, Arabidopsis thaliana
IYRGVRQRNSGKWVSEVREPNKKTRIWLGTFQTAEMAARAHDVAALALRGRSACLNFA

SEQ ID NO: 509 - protein, 58 aa, Arabidopsis thaliana
VYRGVRKRNWGKWVSEIREPRKKSRIWLGTFPSPEMAARAHDVAALSIKGASAILNFP

SEQ ID NO: 510 - protein, 58 aa, Arabidopsis thaliana
SFRGVRQRIWGKWVAEIREPNRGSRLWLGTFPTAQEAASAYDEAAKAMYGPLARLNFP

SEQ ID NO: 511 - protein, 58 aa, Arabidopsis thaliana
RYRGVRQRSWGKWVAEIREPRKRTRKWLGTFATAEDAARAYDRAAVYLYGSRAQLNLT

SEQ ID NO: 512 - protein, 58 aa, Arabidopsis thaliana
LYRGVRQRHWGKWVAEIRLPRNRTRLWLGTFDTAEEAALAYDKAAYKLRGDFARLNFP

SEQ ID NO: 513 - protein, 58 aa, Arabidopsis thaliana
KFRGVRQRPWGKWAAEIRDPSRRVRVWLGTFDTAEEAAIVYDNAAIQLRGPNAELNFP

SEQ ID NO: 514 - protein, 58 aa, Arabidopsis thaliana
VYRGIRKRPWGKWAAEIRDPRKGVRVWLGTFNTAEEAAMAYDVAAKQIRGDKAKLNFP

SEQ ID NO: 515 - protein, 58 aa, Arabidopsis thaliana
RFLGVRRRPWGRYAAEIRDPTTKERHWLGTFDTAEEAALAYDRAARSMRGTRARTNFV

SEQ ID NO: 516 - protein, 58 aa, Arabidopsis thaliana
RYRGVRRRPWGRYAAEIRDPMSKERRWLGTFDTAEQAACAYDSAARAFRGAKARTNFT

SEQ ID NO: 517 - protein, 59 aa, Arabidopsis thaliana
SYRGVRRRPWGKFAAEIRDSTRNGIRVWLGTFESAEEAALAYDQAAFSMRGSSAILNFS

SEQ ID NO: 518 - protein, 58 aa, Arabidopsis thaliana
KYRGVRQRPWGKWAAEIRDPHKATRVWLGTFETAEAAARAYDAAALRFRGSKAKLNFP

SEQ ID NO: 519 - protein, 58 aa, Arabidopsis thaliana
KPVGVRQRKWGKWAAEIRHPITKVRTWLGTYETLEQAADAYATKKLEFDALAAATSAA

SEQ ID NO: 520 - protein, 58 aa, Arabidopsis thaliana
YPVGVRPRPSGKFAAEILNPFTKTKKWLGTYETPAEAEKAYVDKKVEYDALASSGSAV

SEQ ID NO: 521 - protein, 58 aa, Arabidopsis thaliana
KPVGVRQRKWGKWAAEIRDPIKKTRTWLGTFDTLEEAAKAYDAKKLEFDAIVAGNVST

SEQ ID NO: 522 - protein, 58 aa, Arabidopsis thaliana
GFKGVRRRPWGKFAAEIRNPFEKKRKWLGTFPTEEEAAEAYQKSKREFDERLGLVKQE

SEQ ID NO: 523 - protein, 58 aa, Arabidopsis thaliana
KHKGVRKKPSGKWAAEIWDPSLKVRRWLGTFPTAEMAAKAYNDAAAEFVGRRSARRGT

SEQ ID NO: 524 - protein, 58 aa, Arabidopsis thaliana
KYKGVRKKPSGKWAAEIWDPRSKSRRWLGTFLTAEMAAQSYNDAAAEYRARRGKTNGE

SEQ ID NO: 525 - protein, 58 aa, Arabidopsis thaliana
KHKGVRKKPSGKWSAEIWDPSTRTRRWLGTFPTAEMAADAYDEAAAALVEKRSARRGS

SEQ ID NO: 526 - protein, 6 aa, Artificial sequence
  Cleavage site of the N-terminal secretion signal in SEQ ID NO: 95
SHAASP

The invention claimed is:

1. A method for enhancing seed yield-related traits in a plant relative to a control plant, comprising introducing and expressing in a plant a nucleic acid encoding a chloride channel-like (CLC-like) polypeptide, and selecting for a plant having enhanced seed yield-related traits relative to a control plant, wherein said nucleic acid is selected from the group consisting of:
   (a) a nucleic acid comprising the nucleotide sequence of SEQ ID NO: 1;
   (b) a nucleic acid encoding a polypeptide comprising the amino acid sequence of SEQ ID NO: 2; and
   (c) a nucleic acid encoding a polypeptide having at least 95% sequence identity to the amino acid sequence of SEQ ID NO: 2.

2. The method of claim 1, wherein said nucleic acid encodes a polypeptide having the amino acid sequence of SEQ ID NO: 2.

3. The method of claim 1, wherein said nucleic acid encodes a polypeptide having nitrate/H$^+$ exchanging activity.

4. The method of claim 1, wherein the enhanced seed yield-related traits are obtained under conditions of drought stress or salt stress.

5. The method of claim 1, wherein said seed yield-related traits comprise total weight of seeds, number of filled seed, seed fill rate, harvest index, and/or Thousand Kernel Weight (TKW).

6. The method of claim 1, wherein said nucleic acid is operably linked to a constitutive promoter, a GOS2 promoter, or a GOS2 promoter from rice.

7. The method of claim 1, wherein the plant is a crop plant, a monocot, or a cereal, or wherein the plant is rice, maize, wheat, barley, millet, rye, triticale, sorghum emmer, spelt, secale, einkorn, teff, milo, or oats.

8. A method for the production of a transgenic plant having increased seed yield relative to a control plant, comprising:

(a) introducing and expressing in a plant a nucleic acid encoding a CLC-like polypeptide wherein said nucleic acid is selected from the group consisting of:
   (i) a nucleic acid comprising the nucleotide sequence of SEQ ID NO: 1;
   (ii) a nucleic acid encoding a polypeptide comprising the amino acid sequence of SEQ ID NO: 2; and
   (iii) a nucleic acid encoding a polypeptide having at least 95% sequence identity to the amino acid sequence of SEQ ID NO: 2;
(b) cultivating the plant under conditions promoting plant growth and development; and
(c) selecting for a plant having increased seed yield relative to a control plant.

9. The method of claim 8, wherein the increased seed yield comprise increased total weight of seeds, increased number of filled seed, increased seed fill rate, increased harvest index, and/or increased Thousand Kernel Weight (TKW).

10. A transgenic plant obtained by the method of claim 8, or a plant part, seed, or progeny of said transgenic plant, wherein said transgenic plant, or said plant part, seed, or progeny, comprises a recombinant nucleic acid encoding said CLC-like polypeptide operably linked to a constitutive promoter, a GOS2 promoter, or a GOS2 promoter from rice.

11. A transgenic plant having increased seed yield relative to a control plant produced by the method of claim 1, wherein said nucleic acid is operably linked to a constitutive promoter, a GOS2 promoter, or a GOS2 promoter from rice.

12. Harvestable parts of the transgenic plant of claim 11, wherein said harvestable parts comprise a recombinant nucleic acid encoding said CLC-like polypeptide operably linked to a constitutive promoter, a GOS2 promoter, or a GOS2 promoter from rice, and wherein said harvestable parts are shoot biomass and/or seeds.

13. Products derived from the transgenic plant of claim 11 and/or from harvestable parts of said plant, wherein said products comprise a recombinant nucleic acid encoding said CLC-like polypeptide operably linked to a constitutive promoter, a GOS2 promoter, or a GOS2 promoter from rice.

14. A method for increasing biomass and/or seed yield in a plant relative to a control plant, comprising:
   (a) introducing and expressing in a plant a nucleic acid encoding a polypeptide having at least 95% sequence identity to the amino acid sequence of SEQ ID NO: 2; and
   (b) selecting for a plant having increased biomass and/or seed yield relative to a control plant by measuring and comparing biomass and/or one or more seed-related parameters selected from the group consisting of total weight of seeds, number of filled seed, seed fill rate, harvest index, and Thousand Kernel Weight (TKW) of said plant and said control plant.

15. The method of claim 14, wherein said nucleic acid encodes a polypeptide having the amino acid sequence of SEQ ID NO: 2.

16. The method of claim 8, wherein said nucleic acid encoding a CLC-like polypeptide is operably linked to a GOS2 promoter or a GOS2 promoter from rice.

17. The transgenic plant of claim 10, wherein said recombinant nucleic acid is operably linked to a GOS2 promoter.

18. The products of claim 13, wherein said recombinant nucleic acid is operably linked to a GOS2 promoter.

* * * * *